United States Patent
Glenn et al.

(10) Patent No.: US 6,544,772 B1
(45) Date of Patent: Apr. 8, 2003

(54) POLYNUCLEOTIDES, MATERIALS INCORPORATING THEM, AND METHODS FOR USING THEM

(75) Inventors: Matthew Glenn, Auckland (NZ); Ilkka J. Havukkala, Auckland (NZ); Leonard N. Bloksberg, Auckland (NZ); Mark W. Lubbers, Palmerston North (NZ); James Dekker, Palmerston North (NZ); Anna C. Christensson, Lund (SE); Ross Holland, Palmerson North (NZ); Paul W. O'Toole, Palmerston North (NZ); Julian R. Reid, Palmerston North (NZ); Timothy Coolbear, Palmerston North (NZ)

(73) Assignees: Genesis Research & Development Corp. Ltd, Parnell (NZ); Via Lachia Bioscience (NZ) Ltd., Auckland (NZ)

( * ) Notice: Subject to any disclaimer, the term of this patent is extended or adjusted under 35 U.S.C. 154(b) by 316 days.

(21) Appl. No.: 09/634,238

(22) Filed: Aug. 8, 2000

(51) Int. Cl.$^7$ .......................... C12N 1/21; C12N 15/63; C12N 15/31
(52) U.S. Cl. .............................. 435/252.3; 435/320.1; 536/23.7
(58) Field of Search ........................... 435/252.3, 320.1; 536/23.7

(56) References Cited

PUBLICATIONS

GenBank Accession No. L04938, submitted Jul. 14, 1993.*
Stentz, Régis, et al., "Molecular Cloning and Analysis of the ptsHI Operon in *Lactobacillus sake*", *Applied and Environmental Microbiology*, vol. 63, No. 6, pp. 2111–2116 (1997).
Luesink, Evert J., et al., "Molecular Characterization of the *Lactococcus lactis* ptsHI Operon and Analysis of the Regulatory Role of HPr", *Journal of Bacteriology*, vol. 181, No. 3, pp. 764–771 (1999).
Groisillier, Agnès, et al., "Comparison of partial malolactic enzyme gene sequences for phylogenetic analysis of some lactic acid bacteria species and relationships with the malic enzyme", *International Journal of Systematic Bacteriology*, vol. 49, pp. 1417–1428 (1999).
GenBank Accession No. AF098777, submitted Jun. 2, 1999.
Kunji, Edmund R.S., et al., "The proteolytic systems of lactic acid bacteria", *Antonie van Leeuwenhoek*, vol. 70, pp. 187–221 (1996).
Branny, Pavel, et al., "An operon encoding three glycolytic enzymes in *Lactobacillus delbrueckii* subsp. *bulgaricus*: glyceraldehyde–3–phosphate dehydrogenase, phoshoglycerate kinase and triosephosphate isomerase", *Microbiology*, vol. 144, pp. 905–914 (1998).
GenBank Accession No. AJ000339, submitted May 8, 1998.
Hidalgo, Elena, et al., "Molecular Cloning and DNA Sequencing of the *Escherichia coli* K–12 ald Gene Encoding Aldehyde Dehydrogenase", *Journal of Bacteriology*, vol. 173, No. 19, pp. 6118–6123 (1991).
GenBank Accession No. P33898, submitted Jul. 15, 1999.
Schmidt, G., et al., "Molecular characterisation of the dnaK operon of *Lactobacillus sakei* LTH681", *Systematic and Applied Microbiology*, vol. 22, No. 3, pp. 321–328 (1999).

* cited by examiner

*Primary Examiner*—John S. Brusca
(74) *Attorney, Agent, or Firm*—Janet Sleath; Ann W. Speckman

(57) ABSTRACT

Novel polynucleotides isolated from *Lactobacillus rhamnosus*, as well as probes and primers, genetic constructs comprising the polynucleotides, biological materials, including plants, microorganisms and multicellular organisms incorporating the polynucleotides, polypeptides expressed by the polynucleotides, and methods for using the polynucleotides and polypeptides are disclosed.

9 Claims, No Drawings

POLYNUCLEOTIDES, MATERIALS INCORPORATING THEM, AND METHODS FOR USING THEM

TECHNICAL FIELD OF THE INVENTION

This invention relates to polynucleotides isolated from lactic acid bacteria, including partial and extended sequences, as well as to probes and primers specific to the polynucleotides; DNA constructs comprising the polynucleotides; biological materials, including plants, microorganisms and multicellular organisms, incorporating the polynucleotides; polypeptides expressed by the polynucleotides; and methods for using the polynucleotides and polypeptides.

BACKGROUND OF THE INVENTION

The present invention relates to polynucleotides isolated from a specific strain of lactic acid bacteria, namely *Lactobacillus rhamnosus* HN001 (*L. rhamnosus* HN001). Lactic acid bacteria, and their enzymes, are the major determinants of flavor and fermentation characteristics in fermented dairy products, such as cheese and yogurt. Flavors are produced through the action of bacteria and their enzymes on proteins, carbohydrates and lipids.

*Lactobacillus rhamnosus* strain HN001 are heterofermentative bacteria that are Gram positive, non-motile, non-spore forming, catalase negative, facultative anaerobic rods exhibiting an optimal growth temperature of 37±1° C. and an optimum pH of 6.0–6.5. Experimental studies demonstrated that dietary supplementation with *Lactobacillus rhamnosus* strain HN001 induced a sustained enhancement in several aspects of both natural and acquired immunity (See PCT International Publication No. WO 99/10476). In addition, *L. rhamnosus* HN001, and certain other Gram-positive bacteria can specifically and directly modulate human and animal health (See, for example, Tannock et al., *Applied Environ. Microbiol.* 66:2578–2588, 2000; Gill et al., *Brit. J. Nutrition* 83:167–176; Quan Shu et al., *Food and Chem. Toxicol.* 38:153–161, 2000; Quan Shu et al., *Intl. J. Food Microbiol.* 56:87–96, 2000; Quan Shu et al., *Intl. Dairy J.* 9:831–836, 1999; Prasad et al., *Intl. Dairy J.* 8:993–1002, 1998; Sanders and Huis in't Veld, *Antonie van Leeuwenhoek* 76:293–315, 1999; Salminen et al., 1998. In: Lactic Acid Bacteria, Salminen S and von Wright A (eds)., Marcel Dekker Inc, New York, Basel, Hong Kong, pp. 211–253; Delcour et al., *Antonie van Leeuwenhoek* 76:159–184, 1999; Blum et al., *Antonie van Leeuwenhoek* 76:199–205, 1999; Yasui et al., *Antonie van Leeuwenhoek* 76:383–389, 1999; Hirayama and Rafter, *Antonie van Leeuwenhoek* 76:391–394, 1999; Ouwehand, 1998. In: Lactic Acid Bacteria, Salminen S and von Wright A (eds)., Marcel Dekker Inc, New York, Basel, Hong Kong, pp. 139–159; Isolauri et al., S 1998. In: Lactic Acid Bacteria, Salminen S and von Wright A (eds)., Marcel Dekker Inc, New York, Basel, Hong Kong, pp. 255–268; Lichtenstein and Goldin, 1998. In: Lactic Acid Bacteria, Salminen S and von Wright A (eds)., Marcel Dekker Inc, New York, Basel, Hong Kong, pp. 269–277; El-Nezami and Ahokas, 1998. In: Lactic Acid Bacteria, Salminen S and von Wright A (eds)., Marcel Dekker Inc, New York, Basel, Hong Kong, pp. 359–367; Nousianen et al., 1998. In: Lactic Acid Bacteria, Salminen S and von Wright A (eds)., Marcel Dekkcer Inc, New York, Basel, Hong Kong, pp. 437–473; Meisel and Bockelmann, *Antonie van Leeuwenhoek* 76:207–215, 1999; Christensen et al., Antonie van Leeuwenhoek 76:217–246, 1999; Dunne et al., *Antonie van Leeuwenhoek* 76:279–292, 1999). Beneficial health effects attributed to these bacteria include the following:

Increased resistance to enteric pathogens and anti-infection activity, including treatment of rotavirus infection and infantile diarrhea—due to increases in antibody production caused by an adjuvant effect, increased resistance to pathogen colonization; alteration of intestinal conditions, such as pH; and the presence of specific antibacterial substances, such as bacteriocins and organic acids.

Aid in lactose digestion—due to lactose degradation by bacterial lactase enzymes (such as beta-galactosidase) that act in the small intestine.

Anti-cancer (in particular anti-colon cancer) and anti-mutagenesis activities—due to anti-mutagenic activity; alteration of procancerous enzymatic activity of colonic microbes; reduction of the carcinogenic enzymes azoreductase, beta-glucuronidase and nitroreductase in the gut and/or faeces; stimulation of immune function; positive influence on bile salt concentration; and antioxidant effects.

Liver cancer reduction—due to aflatoxin detoxification and inhibition of mould growth.

Reduction of small bowel bacterial overgrowth—due to antibacterial activity; and decrease in toxic metabolite production from overgrowth flora.

Immune system modulation and treatment of autoimmune disorders and allergies—due to enhancement of non-specific and antigen-specific defence against infection and tumors; enhanced mucosal immunity; adjuvant effect in antigen-specific immune responses; and regulation of Th1/Th2 cells and production of cytokines.

Treatment of allergic responses to foods—due to prevention of antigen translocation into blood stream and modulation of allergenic factors in food.

Reduction of blood lipids and prevention of heart disease—due to assimilation of cholesterol by bacteria; hydrolysis of bile salts; and antioxidative effects.

Antihypertensive effect—bacterial protease or peptidase action on milk peptides produces antihypertensive peptides. Cell wall components act as ACE inhibitors.

Prevention and treatment of urogenital infections—due to adhesion to urinary and vaginal tract cells resulting in competitive exclusion; and production of antibacterial substances (acids, hydrogen peroxide and biosurfactants).

Treatment of inflammatory bowel disorder and irritable bowel syndrome—due to immuno-modulation; increased resistance to pathogen colonization; alteration of intestinal conditions such as pH; production of specific antibacterial substances such as bacteriocins, organic acids and hydrogen peroxide and biosurfactants; and competitive exclusion.

Modulation of infective endocarditis—due to fibronectin receptor-mediated platelet aggregation associated with Lactobacillus sepsis.

Prevention and treatment of *Helicobacter pylon* infection—due to competitive colonization and antibacterial effect.

Prevention and treatment of hepatic encephalopathy—due to inhibition and/or exclusion of urease-producing gut flora.

Improved protein and carbohydrate utilisation and conversion—due to production of beneficial products by bacterial action on proteins and carbohydrates.

Other beneficial health effects associated with *L. rhamnosus* include: improved nutrition; regulation of colonocyte proliferation and differentiation; improved lignan and isoflavone metabolism; reduced mucosal permeability; detoxification of carcinogens and other harmful compounds; relief of constipation and diarrhea; and vitamin synthesis, in particular folate.

Peptidases are enzymes that break the peptide bonds linking the amino group of one amino acid with the carboxy group (acid group) of an adjacent amino acid in a peptide chain. The bonds are broken in a hydrolytic reaction. There is a large family of peptidase enzymes that are defined by their specificity for the particular peptides bonds that they cleave (Barrett A J, Rawlings N D and Woessner J F (Eds.) 1998. *Handbook of proteolytic enzymes*. Academic Press, London, UK). The two main families are exopeptidases and endopeptidases.

Exopeptidases cleave amino acids from the N- or C-terminus of a peptide chain, releasing free amino acids or short (di- and tripeptides). Different types of exopeptidases include:

Aminopeptidases—release a free amino acid from the N-terminus of a peptide chain;

dipeptidyl-peptidase (also known as dipeptidyl-aminopeptidases)—release a dipeptide from the N-terminus of a peptide chain;

tripeptidyl-peptidases (also known as tripeptidyl-aminopeptidases)—release a trifpeptide from the N-terminus of a peptide chain);

carboxypeptidases—release a free amino acid from the C-terminus of a peptide chain;

peptidyl-dipeptidase—release a dipeptide from the C-terminus of a peptide chain;

dipeptidases—release two free amino acids from a dipeptide; and tripeptidases—release a free amino acid and a dipeptide from a tripeptide.

Endopeptidases hydrolyze peptide bonds internally within a peptide and are classified on the basis of their mode of catalysis:

serine-endopeptidases—depend on serine (or threonine) as the nucleophile in the catalytic reaction;

cysteine-endopeptidases—depend on the sulphydryl group of cysteine as the nucleophile in the catalytic reaction;

aspartic-endopeptidases—contain aspartate residues that act as ligands for an activated water molecule which acts as the nucleophile in the catalytic reaction; and metallo-endopeptidases—contain one or more divalent metal ions that activate the water molecule that acts as the nucleophile in the catalytic reaction.

Peptidases are important enzymes in the process of cheese ripening and the development of cheese flavor. The hydrolysis of milk caseins in cheese results in textural changes and the development of cheese flavors. The raft of proteolytic enzymes that cause this hydrolysis come from the lactic acid bacteria that are bound up in the cheese—either starter cultures that grow up during the manufacture of the cheese, or adventitious and adjunct non-starter lactic acid bacteria that grow in the cheese as it ripens (Law Haandrikman, *Int. Dairy J.* 7:1–11, 1997).

Many other enzymes can also influence dairy product flavor, and functional and textural characteristics, as well as influencing the fermentation characteristics of the bacteria, such as speed of growth, acid production and survival (Urbach, *Int. Dairy J.* 5:877–890, 1995; Johnson and Somkuti, *Biotech. Appl. Biochem.* 13:196–204, 1991; El Soda and Pandian, *J. Dairy Sci.* 74:2317–2335, 1991; Fox et al,. In Cheese: chemistry, physics and microbiology. Volume 1, General aspects, $2^{nd}$ edition, P Fox (ed) Chapman and Hall, London; Christensen et al., *Antonie van Leeuwenhoek* 76:217–246, 1999; Stingle et al., *J. Bacteriol.* 20:6354–6360, 1999; Stingle et al., *Mol. Microbiol.* 32:1287–1295, 1999; Lemoine et al., *Appl. Environ. Microbiol.* 63:1512–3518, 1997). Enzymes influencing specific characteristics and/or functions include the following:

Lysis of cells. These enzymes are mostly cell wall hydrolases, including amidases; muramidases; lysozymes, including N-acetyl muramidase; muramidase; N-acetylglucosaminidase; and N-acetylmuramoyl-L-alanine amidase. DEAD-box helicase proteins also influence autolysis.

Carbohydrate utilization. Lactose, citrate and diacetyl metabolism, and alcohol metabolism are particularly important. The enzymes involved include beta-galactosidase, lactate dehydrogenase, citrate lyase, citrate permease, 2,3 butanediol dehydrogenase (acetoin reductase), acetolactate decaboxylase, acetolactate synthase, pyruvate decarboxylase, pyruvate formate lyase, diacetyl synthase, diacetyl reductase, alcohol decarboxylase, lactate dehydrogenase, pyruvate dehydrogenase, and aldehyde dehydrogenase.

Lipid degradation, modification or synthesis. Enzymes involved include lipases, esterases, phospholipases, serine hydrolases, desaturases, and linoleate isomerase.

Polysaccharide synthesis. Polysaccharides are important not only for potential immune enhancement and adhesion activity but are important for the texture of fermented dairy products. The enzymes involved are a series of glucosyl transferases, including beta-(1–3) glucosyl transferase, alpha-N acetylgalactosaminyl transferase, phosphogalactosyl transferase, alpha-glycosyl transferase, UDP-N-acetylglucosamine C4 epimerase and UDP-N-acetylglucosamine transferase.

Amino acid degradation. Enzymes include glutamate dehydrogenase, aminotransferases, amino acid decarboxylases, and enzymes involved in sulphur amino acid degradation including cystothione beta-lyase.

Sequencing of the genomes, or portions of the genomes, of numerous organisms, including humans, animals, microorganisms and various plant varieties, has been and is being carried out on a large scale. Polynucleotides identified using sequencing techniques may be partial or full-length genes, and may contain open reading frames, or portions of open reading frames, that encode polypeptides. Putative polypeptides may be identified based on polynucleotide sequences and further characterized. The sequencing data relating to polynucleotides thus represents valuable and useful information.

Polynucleotides and polypeptides may be analyzed for varying degrees of novelty by comparing identified sequences to sequences published in various public domain databases, such as EMBL. Newly identified polynucleotides and corresponding putative polypeptides may also be compared to polynucleotides and polypeptides contained in public domain information to ascertain homology to known polynucleotides and polypeptides. In this way, the degree of similarity, identity or homology of polynucleotides and polypeptides having an unknown function may be determined relative to polynucleotides and polypeptides having known functions.

Information relating to the sequences of isolated polynucleotides may be used in a variety of ways. Specified polynucleotides having a particular sequence may be isolated, or synthesized, for use in in vivo or in vitro experimentation as probes or primers. Alternatively, collections of sequences of isolated polynucleotides may be stored using magnetic or optical storage medium and analyzed or manipulated using computer hardware and software, as well as other types of tools.

SUMMARY OF THE INVENTION

The present invention provides isolated polynucleotides comprising a sequence selected from the group consisting of: (a) sequences identified in the attached Sequence Listing as SEQ ID NOS: 1–213 and 399–410; (b) variants of those sequences; (c) extended sequences comprising the sequences set out in SEQ ID NOS: 1–213 and 399–410, and their variants; and (d) sequences comprising at least a specified number of contiguous residues of a sequence of SEQ ID NOS: 1–213 and 399–410 (x-mers). Oligonucleotide probes and primers corresponding to the sequences set out in SEQ ID NOS: 1–213 and 399–410, and their variants are also provided. All of these polynucleotides and oligonucleotide probes and primers are collectively referred to herein, as "polynucleotides of the present invention."

The polynucleotide sequences identified as SEQ ID NOS: 1–213 and 399–410 were derived from a microbial source, namely from fragmented genomic DNA of *Lactobacillus rhamnosus*, strain HN001, described in PCT International Publication No. WO 99/10476. *Lactobacillus rhamnosus* strain HN001 are heterofermentative bacteria that are Gram positive, non-motile, non-spore forming, catalase negative, facultative anaerobic rods exhibiting an optimal growth temperature of 37±1° C. and an optimum pH of 6.0–6.5. Experimental studies demonstrated that dietary supplementation with *Lactobacillus rhamnosus* strain HN001 induced a sustained enhancement in several aspects of both natural and acquired immunity. A biologically pure culture of *Lactobacillus rhamnosus* strain HN001 was deposited at the Australian Government Analytical Laboratories (AGAL), The New South Wales Regional Laboratory, 1 Suakin Street, Pymble, NSW 2073, Australia, as Deposit No. NM97/09514, dated Aug. 18, 1997.

The polynucleotide sequences disclosed herein are primarily "partial" sequences in that they do not represent a full-length gene encoding a full-length polypeptide. Such partial sequences may be extended by analyzing and sequencing various DNA libraries using primers and/or probes and well-known hybridization and/or PCR techniques. The partial sequences disclosed herein may thus be extended until an open reading frame encoding a polypeptide, a full-length polynucleotide and/or gene capable of expressing a polypeptide, or another useful portion of the genome is identified. Such extended sequences, including full-length polynucleotides and genes, are described as "corresponding to" a sequence identified as one of the sequences of SEQ ID NOS: 1–213 and 399–410 or a variant thereof, or a portion of one of the sequences of SEQ ID NOS: 1–213 and 399–410 or a variant thereof, when the extended polynucleotide comprises an identified sequence or its variant, or an identified contiguous portion (x-mer) of one of the sequences of SEQ ID NOS: 1–213 and 399–410 or a variant thereof.

The polynucleotides identified as SEQ ID NOS: 1–213 and 399–410 were isolated from *Lactobacillus rhamnosus* genomic DNA clones and represent sequences that are present in the cells from which the DNA was prepared. The sequence information may be used to identify and isolate, or synthesize, DNA molecules such as promoters, DNA-binding elements, open reading frames or full-length genes, that then can be used as expressible or otherwise functional DNA in transgenic organisms. Similarly, RNA sequences, reverse sequences, complementary sequences, antisense sequences and the like, corresponding to the polynucleotides of the present invention, may be routinely ascertained and obtained using the polynucleotides identified as SEQ ID NOS: 1–213 and 399–410.

The present invention further provides isolated polypeptides encoded, or partially encoded by the polynucleotides disclosed herein. In certain specific embodiments, the polypeptides of the present invention comprise a sequence selected from the group consisting of sequences identified as SEQ ID NO: 214–398 and 411–422, and variants thereof. Polypeptides encoded by the polynucleotides of the present invention may be expressed and used in various assays to determine their biological activity. Such polypeptides may be used to raise antibodies, to isolate corresponding interacting proteins or other compounds, and to quantitatively determine levels of interacting proteins or other compounds.

Genetic constructs comprising the inventive polynucleotides are also provided, together with transgenic host cells comprising such constructs and transgenic organisms, such as microbes, comprising such cells.

The present invention also contemplates methods for modulating the polynucleotide and/or polypeptide content and composition of an organism, such methods involving stably incorporating into the genome of the organism a genetic construct comprising a polynucleotide of the present invention. In one embodiment, the target organism is a microbe, preferably a microbe used in fermentation, more preferably a microbe of the genus Lactobacillus, and most preferably *Lactobacillus rhamnosus*, or other closely microbial related species used in the dairy industry. In a related aspect, methods for producing a microbe having an altered genotype and/or phenotype is provided, such methods comprising transforming a microbial cell with a genetic construct of the present invention to provide a transgenic cell, and cultivating the transgenic cell under conditions conducive to growth and multiplication. Organisms having an altered genotype or phenotype as a result of modulation of the level or content of a polynucleotide or polypeptide of the present invention compared to a wild-type organism, as well as components and progeny of such organisms, are contemplated by and encompassed within the present invention.

The isolated polynucleotides of the present invention may be usefully employed for the detection of lactic acid bacteria, preferably *L. rhamnosus*, in a sample material, using techniques well known in the art, such as polymerase chain reaction (PCR) and DNA hybridization, as detailed below.

The inventive polynucleotides and polypeptides may also be employed in methods for the selection and production of more effective probiotic bacteria; as "bioactive" (health-promoting) ingredients and health supplements, for immune function enhancement; for reduction of blood lipids such as cholesterol; for production of bioactive material from genetically modified bacteria; as adjuvants; for wound healing; in vaccine development, particularly mucosal vaccines; as animal probiotics for improved animal health and productivity; in selection and production of genetically modified rumen microorganisms for improved animal nutrition and productivity, better flavor and improved milk composition; in methods for the selection and production of better natural food bacteria for improved flavor, faster flavor development, better fermentation characteristics, vitamin synthesis and improved textural characteristics; for the production of improved food bacteria through genetic modification; and for the identification of novel enzymes for the production of, for example, flavors or aroma concentrates.

The isolated polynucleotides of the present invention also have utility in genome mapping, in physical mapping, and in positional cloning of genes of more or less related microbes. Additionally, the polynucleotide sequences identified as SEQ ID NOS: 1–213 and 399–410, and their variants, may be used to design oligonucleotide probes and primers. Oligonucleotide probes and primers have sequences that are substantially complementary to the polynucleotide of interest over a certain portion of the polynucleotide. Oligonucleotide probes designed using the polynucleotides of the present invention may be used to detect the presence and examine the expression patterns of genes in any organism having sufficiently similar DNA and RNA sequences in their cells, using techniques that are well known in the art, such as slot blot DNA hybridization techniques. Oligonucleotide primers designed using the polynucleotides of the present invention may be used for PCR amplifications. Oligonucleotide probes and primers designed using the polynucleotides of the present invention may also be used in connection with various microarray technologies, including the microarray technology of Incyte Genomics Inc. (Palo Alto, Calif.).

The polynucleotides of the present invention may also be used to tag or identify an organism or derived material or product therefrom. Such tagging may be accomplished, for example, by stably introducing a non-disruptive non-functional heterologous polynucleotide identifier into an organism, the polynucleotide comprising at least a portion of a polynucleotide of the present invention.

The polynucleotides of the present invention may also be used as promoters, gene regulators, origins of DNA replication, secretion signals, cell wall or membrane anchors for genetic tools (such as expression or integration vectors).

All references cited herein, including patent references and non-patent publications, are hereby incorporated by reference in their entireties.

DETAILED DESCRIPTION

The polynucleotides disclosed herein were isolated by high throughput sequencing of DNA libraries from the lactic acid bacteria *Lactobacillus rhamnosus* as described in Example 1. Cell wall, cell surface and secreted components of lactic acid bacteria are known to mediate immune modulation, cell adhesion and antibacterial activities, resulting in many beneficial effects including: resistance to enteric pathogens: modulation of cancer, including colon cancer: anti-mutagenesis effects; reduction of small bowel bacterial overgrowth; modulation of auto-immune disorders; reduction in allergic disorders; modulation of urogenital infections, inflammatory bowel disorder, irritable bowel syndrome, *Helicobacter pylori* infection and hepatic encephalopathy; reduction of infection with pathogens; regulation of colonocyte proliferation and differentiation; reduction of mucosal permeability; and relief of constipation and diarrhea. These cell components include, but are not limited to, peptidoglycans, teichoic acids, lipoteichoic acids, polysaccharides, adhesion proteins, secreted proteins, surface layer or S-layer proteins, collagen binding proteins and other cell surface proteins, and antibacterial substances such as bacteriocins and organic acids produced by these bacteria. Polynucleotides involved in the synthesis of these proteins and in the synthesis, modification, regulation, transport, synthesis and/or accumulation of precursor molecules for these proteins can be used to modulate the immune effects, antibacterial, cell adhesion and competitive exclusion effects of the bacteria or of components that might be produced by these bacteria.

In order to function effectively as probiotic bacteria, *L. rhamnosus* HN001 must survive environmental stress conditions in the gastrointestinal tract, as well as commercial and industrial processes. Modification of particular polynucleotides or regulatory processes have been shown to be effective against a number of stresses including oxidative stress, pH, osmotic stress, dehydration, carbon starvation, phosphate starvation, nitrogen starvation, amino acid starvation, heat or cold shock and mutagenic stress. Polynucleotides involved in stress resistance often confer multistress resistance, i.e., when exposed to one stress, surviving cells are resistant to several non-related stresses. Bacterial genes and/or processes shown to be involved in multistress resistance include:

Intracellular phosphate pools—inorganic phosphate starvation leads to the induction of pho regulon genes, and is linked to the bacterial stringent response. Gene knockouts involving phosphate receptor genes appear to lead to multistress resistance.

Intracellular guanosine pools—purine biosynthesis and scavenger pathways involve the production of phosphate-guanosine compounds that act as signal molecules in the bacterial stringent response. Gene knockouts involving purine scavenger pathway genes appear to confer multi-stress resistance.

Osmoregulatory molecules—small choline-based molecules, such as glycine-betaine, and sugars, such as trehalose, are protective against osmotic shock and are rapidly imported and/or synthesized in response to increasing osmolarity.

Acid resistance—lactobacilli naturally acidify their environment through the excretion of lactic acid, mainly through the cit operon genes responsible for citrate uptake and utilization.

Stress response genes—a number of genes appear to be induced or repressed by heat shock, cold shock, and increasing salt through the action of specific promoters.

The isolated polynucleotides of the present invention, and genetic constructs comprising such polynucleotides may be employed to produce bacteria having desired phenotypes, including increased resistance to stress and improved fermentation properties.

Many enzymes are known to influence dairy product flavor, functional and textural characteristics as well as general fermentation characteristics such as speed of growth, acid production and survival. These enzymes include those involved in the metabolism of lipids, polysaccharides, amino acids and carbohydrates as well as those involved in the lysis of the bacterial cells.

The isolated polynucleotides and polypeptides of the present invention have demonstrated similarity to polynucleotides and/or polypeptides of known function. The putative identity and functions of the inventive polynucleotides based on such similarities are shown below in Table 1.

TABLE 1

| SEQ ID NO Polynucleotide | SEQ ID NO Polypeptide | Category | Gene function or protein class |
|---|---|---|---|
| 1 | 214 | Multistress resistance | Encodes a purine nucleoside phosphorylase, involved in purine biosynthesis. Its role in maintaining intercellular |

TABLE 1-continued

| SEQ ID NO Polynucleotide | SEQ ID NO Polypeptide | Category | Gene function or protein class |
|---|---|---|---|
| | | | guanosine pools suggests involvement in multistress resistance (Duwat, Rec. Res. Dev. Microbiol. 3:335–348, 1999). |
| 2 | 215 | Multistress resistance | Encodes an AIR carboxylase II responsible for $CO_2$ fixation during purine biosynthesis. Its role in maintaining intracellular guanosine pools suggests links to multistress resistance (Duwat, Rec. Res. Dev. Microbiol. 3:335–348, 1999). |
| 3 | 216 | Acid tolerance and multistress resistance | Induced by low chloride levels in *Lactococcus lactis*, involved in glutamate-dependant resistance to low pH (Sanders et al., Mol. Microbiol. 27:299–310, 1998). Encodes a putative glutamate-gamma-aminobutyrate (GABA) antiporter. May be employed as a controlled expression vector. |
| 4 | 217 | Multistress resistance | ATP binding cassette protein involved in the high-affinity phosphate uptake Pts system. *Bacillus subtilis* also contains duplicated pstB genes (Takemaru et al., Microbiol. 142:2017–2020, 1996). pstB gene knockouts in *Lactococcus lactis* (which has a single pstB gene) exhibit improved resistance to multiple stresses (e.g. heat shock, cold shock, high salt) (Duwat, Rec. Res. Dev. Microbiol. 3:335–348, 1999). May have utility as a controlled expression vector. |
| 5 | 218 | Multistress resistance | Transmembrane protein involved in the Pts system of phosphate uptake. Some Pts gene knockouts appear to enhance multistress resistance in *Lactococcus lactis* (Duwat, Rec. Res. Dev. Microbiol. 3:335–348, 1999). May have utility as a controlled expression vector. |
| 6, 7, 8 | 219–223 | Multistress resistance | Encodes a response regulator belonging to the family of two-component signal transduction family. Activates/represses Pho regulon gene transcription in response to phosphate starvation. Pho regulon include genes for cell cycle control (Han et al., Mol. Gen. Genet. 262:448–452, 1999), exopolysaccharide synthesis (Summers et al., J. Bacteriol. 181:2217–2224, 1999) and intestinal adhesion (von Kruger et al., Microbiol. 145: 2463–2475, 1999) Its response to intracellular phosphate suggests a role in multistress resistance (Duwat, Rec. Res. Dev. Microbiol. 3:335–348, 1999). pnpRS encode a two-component regulatory system located immediately upstream of the Pts regulon (high affinity phosphate transport). pnpRS genes involved in phosphate-uptake regulation in *E. coli*, but not *Streptococcus pneumoniae* (Novak et al., J. Bacteriol. 181:1126–1133, 1999). Potential involvement in intracellular phosphate levels suggests a role in multistress resistance (Duwat, Rec. Res. Dev. Microbiol. 3:335–348, 1999). pnpR encodes a phosphate response regulator, while pnpS is a histidine kinase. May be employed as a controlled expression vector. May have utility in immune modulation, gut adhesion, cell wall synthesis and polysaccharide production. |
| 9, 10 | 224, 225 | Multistress resistance | This gene is similar to a response regulator, which in bacteria are involved in the bacterium's ability to monitor its surroundings and adapt to changes in its environment. Several of these bacterial regulators are involved in virulence and bacterial pathogenesis within the bost (see e.g. U.S. Pat. No. 5,910,572) The response regulators are involved in production of virulence factors, motility, antibiotic resistance and cell replication. Inhibitors of these proteins would be useful in preventing bacterium from progressing to pathogenesis, thus useful in medical treatments against bacteria. Maybe employed as a controlled expression vector. |
| 11 | 226 | Multistress resistance | Encodes a histidine sensor-kinase belonging to the two-component signal transduction family. Mediates response to low phosphate levels and phosphorylase phoB. May affect multistress resistance (Duwat, Rec. Res. Dev. Microbiol. 3:335–348, 1999). May be employed as a controlled expression vector. |
| 13, 15 | 228, 230 | Antibiotic resistance, immune modulation, adhesion, cell wall | Extracellular proteins implicated in antibiotic resistance and host survival, and may also be involved in exopolysaccharide (EPS) synthesis and cell morphology (Stingele at al., Mol. Microbiol. 22:357–366, 1996). Penicillin-binding protein gene can be used for modifications in transgenic bacteria, which can change |

TABLE 1-continued

| SEQ ID NO Polynucleotide | SEQ ID NO Polypeptide | Category | Gene function or protein class |
|---|---|---|---|
| | | synthesis | their susceptibility to penicillin (see e.g. Smith and Klugman, Antimicrob. Agents Chemother. 42:1329–1333, 1998). The DNA or protein can be used in various assays to detect the presence of the gene or protein in various biological samples, where penicillin binding is of interest. May be employed in immune modulation, gut adhesion, cell wall synthesis and polysaccharide production. |
| 14 | 229 | Antibiotic resistance, immune modulation, adhesion, cell wall synthesis | Penicillin-binding protein gene can be used for modifications in transgenic bacteria, which can change their susceptibility to penicillin (see e.g. Smith and Klugman, Antimicrob. Agents Chemother. 42:1329–1333, 1998). The DNA or protein can be used in various assays to detect the presence of the gene or protein in various biological samples, where penicillin binding is of interest. May be employed in immune modulation, gut adhesion, cell wall synthesis and polysaccharide production. |
| 16 | 231 | Antibiotic resistance, immune modulation, adhesion, cell wall synthesis | Encodes a hydrophobic transmembrane protein as part of an ABC-type $Mn^{2+}$ permease complex. Involved in penicillin tolerance in Streptococcus pneumoniae (Novak et al., Microbiol. 29:1285–1296, 1998). May be employed in immune modulation, gut adhesion, cell wall synthesis and polysaccharide production. |
| 17 | 232 | ABC transporter, Bacteriocin | ABC transporter accessory protein, part of a series of four operons in Lactobacillus plantarum activated bacteriocin, plantaricin A. May be involved in bacteriocin transport (Diep et al., J. Bacteriol. 178:4472–4483, 1996). May be employed as an antibacterial for control of infection and food preservation. |
| 18 | 233 | Metabolism, survival | Glyceraldehye-3-P-dehydrogenase is a constitutively expressed glycolytic pathway gene (Branny et al., Microbiol. 144:905–914, 1988). Used as control for mRNA integrity and may be employed in survival and carbohydrate metabolism. May have utility as a controlled expression vector. |
| 19 | 234 | Salt tolerance, survival | Encodes enzyme I (phosphate carrier protein), a component of the phosphoenolpyruvate-carbohydrate phosphotransferase system (PEP-PTS). Affects sugar uptake (Vianna et al., Mol. Microbiol. 36:570–584, 2000) and is induced by osmotic shock (Prasad, unpublished). May be employed in survival and carbohydrate metabolism and as a controlled expression vector. |
| 20 | 235-237 | Flavor, survival | citDEF encode the gamma (acyl carrier protein (ACP)), beta (citryl-S-ACP lyase) and alpha (citrate:acetyl-ACP transferase) subunits of citrate lyase, respectively (Bekal et al., J. Bacteriol. 180:647–654, 1998). Involved in citrate metabolism pathway that results in lactic acid production and acid tolerance (Magni et al., J. Bacteriol.181:1451–1457, 1999) and may be employed in survival and carbohydrate metabolism. |
| 21 | 238 | Flavor | Encodes malate dehydrogenase. Because lactobacilli appear not to have a functioning Krebs cycle, this enzyme may be involved in carbohydrate metabolism, amino acid biosynthesis or L-malate utilization pathways. |
| 22 | 239, 240 | Flavor, survival | Encodes transporter for Mg2+–citrate complexes in Bacillus subtilis (Boorsma et al., J. Bacteriol, 178:6216–6222, 1996) and may be employed in survival and carbohydrate metabolism. |
| 23 | 241 | Salt tolerance, survival | Encodes trehalose-6-phosphate synthetase (Kaasen et al., Gene 145:9–15, 1994), which along with otsB, synthesises trehalose, is a bacterial osmoprotectant. May be involved in carbohydrate and amino acid metabolism, survival and may have utility as a controlled expression vector. |
| 24 | 242 | Salt tolerance, survival | Encodes cytoplasmic trehalose-6-phosphate hydrolase, which degrades trehalose under conditions of low osmolality. Involved in osmoregulation and heat tolerance (Kempf et al., Arch. Microbiol. 170:319–330, 1998) and also survival and carbohydrate metabolism, and may have utility as a controlled expression vector. |
| 25 | 243 | Salt tolerance, survival | Energy coupling component of the proU ABC transporter for glycine betaine and other osmoprotectant (Kempf et al., Arch. Microbiol. 170:319–330, 1998). May have utility in survival. |
| 26 | 244 | Flavor | Encodes crystathionone beta-lyase. Degrades crystathionine to homocystiene as part of the methionine pathway as well as other sulfur-containing substrates |

TABLE 1-continued

| SEQ ID NO Polynucleotide | SEQ ID NO Polypeptide | Category | Gene function or protein class |
|---|---|---|---|
| | | | resulting in important flavor compounds. (Fernandez et al., Appl. Environ. Microbiol. 66:42–48, 2000). |
| 27 | 245 | Polysaccharide production, adhesion, immune modulation | Regulates glucotransferase (Sulavik et al., J. Bacteriol. 174:3577–3586, 1992) and other extracellular proteins (Chausse et al., Infect. Imm. 67:1715–1722, 1999). |
| 28 | 246 | Polysaccharide production, adhesion, immune modulation | Involved in chain length determination and export of capsular polysaccharide in *Streptococcus pneumoniae* (Kolkman et al., J. Biol. Chem. 272:19502–19508, 1997). |
| 29 | 247 | Polysaccharide production, adhesion, immune modulation | Required for capsular polysaccharide synthesis in *Streptococcus pneumoniae*, encodes a beta-1,4-galactosyltransferase (Kolkman et al., Mol. Microbiol. 26:197–208, 1997). |
| 30 | 248 | Polysaccharide production, adhesion, immune modulation | May encode a repeating unit transporter in *Streptococcus pneumoniae*, required for capsule synthesis (Kolkman et al., Mol. Microbiol. 26:197–208,1997). |
| 31 | 249 | Flavor, Bioactive peptides | Peptidases are enzymes that break the peptide bonds linking the amino group of one amino acid with the coboxy group (acid group) of an adjacent amino acid in a peptide chain. Peptidases are important in the process of cheese ripening and the development of cheese flavor. May have utility as a controlled expression vector. |
| 32, 33 | 250, 251 | Cell wall synthesis, Immune modulation, Flavor | Penicillin-binding proteins and membrane-bound serine transferases involved in wall peptidoglycan synthesis (Ghuysen, Trends Microbiol 2:372–380, 1994). Carboxpeptidase activity may also affect cheese flavor (Ferranti et al., J. Dairy Res. 64:601–615, 1997), antibiotic resistance and cell morphology (Stingele et al., Mol. Microbiol. 22:357–366, 1996). |
| 34, 35 | 252, 253 | Manipulation of bacterial adhesion | Transgenic microbes with added, deleted or modified aggregation protein gene can have a modified aggregation response in vitro (useful in bioprocessing with bacteria, e.g. fermentation, flocculation) or in vivo (useful in enhancing/decreasing clumping of bacteria, e.g. in gastrointestinal tract, as desired). Aggregation protein gene can be used also for production of protein as antigen to vaccinate mammals. Gene can be used as vehicle for vaccination by fusing with an exogenous antigen with it, transforming a bacterium and treating the mammal to be immunized with killed or live bacteria for preventive or therapeutic vaccination (see patent WO9947657-A2; *Lactobacillus reuteri* bacterial aggregation protein). The aggregation protein is targeted for the bacterial surface, so this ensures efficient antigen presentation to the immune system as the Lactobacillus or other gastrointestinal bacteria adhere to epithelial cells. Finally, gene is useful for detecting Lactobacillus species using the DNA as detection probe. |
| 36 | 254 | Manipulation of bacterial adhesion | Cytoplasmic pyrophosphatase |
| 37; 51 | 255, 269 | Manipulation of bacterial adhesion | Collagen binding is important property in attachment and potential pathogenesis of various bacteria with mammalian hosts. The gene can be used to screen bacteria with DNA or protein probes/antibodies for the presence of collagen adhesion gene in various pathogenic and non-pathogenic bacteria, e.g. for selection of strains or for diagnostic purposes (see e.g. patent WO9207002). It is known that expression of a collagen adhesin is essential for the attachment of *Staphylococcus aureus* to cartilage, which contains collagen (Switaiski et al., Mol. Microbiol. 7, 99–107, 1993). Deletion/addition or modification of the gene can alter collagen-binding properties of cells to the desired effect in bacteria-host interactions. Finally, protein can be used as an administered reagent in in vitro or in vivo |

TABLE 1-continued

| SEQ ID NO Polynucleotide | SEQ ID NO Polypeptide | Category | Gene function or protein class |
|---|---|---|---|
| 38; 41–43 | 256, 259–261 | Antibacterial | collagen binding reactions. This bacterial toxin gene can be used to develop vaccines against pathogenic bacteria carrying the gene/protein. Transgenic microbes with added, deleted or modified hemolysin protein gene can have a modified hemolytic activity in vitro (useful e.g. in bacteria-based assays) or in vivo (useful in enhancing/decreasing pathogenicity of bacteria, as desired (see e.g. J. Biol. Chem. 267:10902–10909, 1992). Functional expression of the alpha-hemolysin gene of *Staphylococcus aureus* in intact *Escherichia coli* and in cell lysates. Deletion of five C-terminal amino acids selectively impairs hemolytic activity. The peptide itself can be used as a reagent e.g. in in vitro assays of hemolytic activity. |
| 39 | 257 | Inhibition of infection | Autoinducer is part of the quorum sensing system, and is secreted by bacteria and is used to communicate both the cell density and the metabolic potential of the environment. The gene can be used in DNA or protein assays to detect presence of the DNA or protein in microbes. The deletion, addition or modification of the gene can change the intercellular signaling of bacteria, affecting their growth mode, pathogenesis and survival. The peptide can be used as a reagent to modify the bacterial communication in vitro or in vivo. |
| 40 | 258 | Antibacterial Flavor, Cell wall synthesis, Immune modulation | Autolysin control lysing of bacterial cells. It can be used for controlling lysis of food fermenting bacteria, e.g. in cheese production, as well as lysis of pathogenic organisms with in vivo or in vitro administration of the peptide or peptide-producing microorganisms. The deleted/added or modified gene in transgenic bacteria can be used to modify the lysis process as required. The DNA and peptide can be used in developing and using various screening assays to detect presence of hemolysin gene/protein and autolytic activity. |
| 44–47 | 262–265 | Antibacterial Flavor, Cell wall synthesis, Immune modulation | Penicillin-binding protein gene can be used for modifications in transgenic bacteria, which can change their susceptibility to penicillin (see e.g. Smith and Klugman, Antimicrob. Agents Chemother. 42:1329–1333, 1998). Alterations in PBP 1A essential-for high-level penicillin resistance in *Streptococcus pneumoniae*. The DNA or protein can be used in various assays to detect the presence of the gene or protein in various biological samples, where penicillin binding is of interest. |
| 48; 62 | 266, 280 | Inhibition of infection, Adhesion, Immune modulation | The gene is related to a major extracellular protein in Listeria, which seems to be required for adherence to and invasion of 3T6 mouse fibroblasts. This gene can be useful as a probe to detect the presence of the gene/protein in various bacteria. Deletion, addition and modification of the gene in transgenic bacteria can alter their extracellular envelope structure, thereby altering their growth and pathogenicity characteristics. See e.g. Bubert et al., J. Bacteriol. 174(24):8166–8171, 1992. |
| 49 | 267 | Cell adhesion, Immune modulation | This gene is similar to an epidermal surface antigen of *Bacillus subtilis*. It is useful as a vaccine development target. The gene is similar to flotillin, belonging to a new family of caveolae-associated integral membrane proteins. (see Bickel et al., J. Biol. Chem. 272:13793–13802, 1997.) Also similar to reggie genes, associated with cell adhesion molecules (see Lang et al., J. Neurobiol. 37:502–523, 1998.) |
| 50 | 268 | Inhibits anchoring cell surface proteins | This gene is similar to sortase, which is involved in covalent anchoring to the cell wall (see Cossart and Jonquieres, Proc. Natl. Acad. Sci. USA 97:5013–5015, 2000). The gene is useful as a target for antibiotic development as the gene performs a very important function in cell wall protein anchoring. The DNA and protein can be used in vitro and in vivo assays and treatments as a reagent. Transgenic bacteria with deleted, added or modified sortase gene can have modified protein anchoring at the cell surface layer. |
| 52 | 270 | Drug development | This gene is involved in the regulation of lysogeny in the temperate *Bacillus subtilis* phage phi 105, which can make *B. subtilis* immune to infection by phi 105 phage (see Cully and Garro, Gene 38:153–164, 1985). This gene can be used to manipulate bacteria as to their susceptibility to phage invasion and hence acquiring desired/undesired |

TABLE 1-continued

| SEQ ID NO Polynucleotide | SEQ ID NO Polypeptide | Category | Gene function or protein class |
|---|---|---|---|
| 53 | 271 | Antibacterial Cell wall synthesis, Immune modulation | genetic element carried by the phage. Useful for N-acetylmuramoyl-L-alanine amidase activity using the peptide in vitro or in vivo, or transgenic bacteria with the gene expressed to effect the enzyme activity. The DNA or protein can be used in assays to detect the presence of the gene or protein in various assays. This enterotoxin related gene is also a vaccine development target for pathogenic or other undesired bacteria, e.g. various Lactobacillus strains. |
| 55 | 273 | Drug development | This gene is similar to *Shigella flexneri* virG, which is related to virulence during the invasion to host (see Lett et al., J. Bacteriol. 171:353–359, 1989). The gene is useful as a target for vaccine development of bacteria having this kind of gene, as well as manipulation of virulence by deletion, addition or modification of the gene in transgenic bacteria. |
| 56 | 274 | Drug development | This gene is similar to the cyclopropane-fatty-acyl phospholipid synthase of bacteria, and catalyzes a modification of the acyl chains of phospholipid bilayers. This gene is useful in modifying the bacterial phospholipid bilayers by altered enzyme activity, e.g. by deleted, added or modified gene in transgenic bacteria (see e.g. U.S. Pat. No. 5,573,915: Determining the ability of a compound to inhibit the cyclopropanation of mycolic acids in pathogenic mycobacteria). |
| 57 | 275 | Fermentation, manipulation of metabolism, flavor | This enzyme is useful in manipulating alcohol dehydrogenation in vitro or in vivo, e.g. in fermentation processes or with transgenic bacteria with deleted, added or modified alcohol dehydrogenase gene. |
| 58 | 276 | Biotin manipulation for insect control | This enzyme is useful in manipulating biotin carboxylation in vitro or in vivo, e.g. in transgenic plants with deleted, added or modified gene leading to altered biotin metabolism, thus affecting insect herbivores which require plant-derived biotin; may also have utility in manipulation of herbicide tolerance (see U.S. Pat. No. 5,910,626: Acetyl-CoA carboxylase compositions and methods of use). |
| 59 | 277 | Cytotoxin for controlled tissue destruction | Similar to N-Acetylphosphinothricin deactylase (see patent DE19652284-A1; Comamonas sp. N-Acetylphosphinothricin deactylase protein). This gene is useful in related deacetylase reactions, in vitro or in vivo using the proteins as such, of bacteria engineered to produce the enzyme activity. |
| 60 | 278 | Cheese-making, protein degradation | This enzyme is similar to prochymosin, a protein used in cheese making. The gene is useful in protease utilization in protein processing (see e.g. NL8701378; *S. cremoris* proteinase). |
| 61 | 279 | Growth inhibition of microbials, Flavor, Conjugated linoleic acid production | This enzyme is similar to linoleate isomerase (see e.g. WO9932604-A1). This gene is useful in enzyme reactions similar to linoleate isomerase, either as a purified protein, or in transgenic organisms containing the gene effecting the enzyme activity. |
| 63 | 281 | Alkalinity tolerance | This gene is similar to Sec Y Translocase gene, useful for enhancing extracellular protein production by improved transport from cell (see e.g. JP5153979A2: Sec Y protein gene) |
| 64; 65 | 282, 283 | Vaccine development | This gene is similar to a surface antigen, thus useful in vaccine development (surface location enhances its exposure to the immune system). |
| 66 | 284 | Antibacterial Immune modulation | This gene is similar to a gene involved in bacterial wall synthesis, and is thus a target for antibiotic development, as its inhibition would affect growth of the bacterium. |
| 67 | 285 | Mycobacterial vaccine, Immune modulation | This gene is similar to a gene used in mycobacterial vaccine development, and is thus a target for antibiotic development, as its inhibition would affect growth of the bacterium (see e.g. WO9932634-A2: Compositions derived from *Mycobacterium vaccae* and methods for their use). |
| 68 | 286 | Cell to cell interactions, cell differentia- | This gene is similar to hyaluronic acid synthase and may be involved in pathogenesis with cell-cell interactions, differentiation, tissue repair. The gene is also similar to an Enterococcus antigen that is useful in vaccine |

TABLE 1-continued

| SEQ ID NO Polynucleotide | SEQ ID NO Polypeptide | Category | Gene function or protein class |
|---|---|---|---|
| | | tion, cell repair | development (see e.g. WO9850554-A2; *Enterococcus faecalis* antigenic polypeptide fragment EF017). |
| 69 | 287 | Antibacterial Immune modulation | This gene is similar to UDP-N-acetylmuramoylalanine-D-glutamate ligase involved in bacterial cell wall synthesis. Thus it is useful for antibiotic development to inhibit bacterial cell wall synthesis. |
| 72 | 290 | Cell adhesion | This gene is similar to a fibronectin binding protein, which is involved in bacterial entry into mammalian cells (see Joh et al., Matrix Biol. 18:211–223, 1999). Thus this gene is useful in manipulation of the binding process to alter pathogenicity through drugs interfering with the gene product. |
| 73 | 291 | Drug development | This gene is similar to *Salmonella typhimurium* MVIM gene which is related to virulence. The gene is useful as a target for vaccine development of bacteria having this kind of gene, as well as manipulation of virulence by deletion, addition or modification of the gene in transgenic bacteria. |
| 74 | 292 | Drug development Flavor, Autolysis | This gene is similar to the autolysin response regulator of *Bacillus subtilis*. Response regulators in bacteria are involved in the bacterium's ability to monitor its surroundings and adapt to changes in its environment. Several of these bacterial regulators are involved in virulence and bacterial pathogenesis within the host (see e.g. U.S. Pat. No. 5,910,572). Response regulators are involved in production of virulence factors, motility, antibiotic resistance and cell replication. Inhibitors of these proteins would be useful in preventing bacterium from progressing to pathogenesis, thus useful in medical treatments against bacteria. May have utility as a controlled expression vector. |
| 75 | 293 | Drug development | This gene is similar to a response regulator of *Mycobacterium bovis*. Response regulators in bacteria are involved in the bacterium's ability to monitor its surroundings and adapt to changes in its environment. Several of these bacterial regulators are involved in virulence and bacterial pathogenesis within the host (see e.g. U.S. Pat. No. 5,910,572) The response regulators are involved in production of virulence factors, motility, antibiotic resistance and cell replication. Inhibitors of these proteins would be useful in preventing bacterium from progressing to pathogenesis, thus useful in medical treatments against bacteria. May have utility as a controlled expression vector. |
| 76 | 294 | Antibacterial | This gene is similar to one of spinosyn biosynthesis, which is an insecticidal macrolide (see WO9946387-A1: Biosynthetic genes for spinosyn insecticide production). This gene can be useful in a related compound biosynthesis utilization for bioactive compounds. |
| 77 | 295 | Antibacterial Polysaccharide production | The gene is related to a exopolysaccharide synhesis gene (See e.g. Stingele et al., J. Bacteriol. 178:1680–1690, 1996). Deletion, addition and modification of the gene in transgenic bacteria can alter their extracellular envelope structure, thereby altering their growth and pathogenicity characteristics. |
| 78 | 296 | Drug development | This gene is similar to *E. coli* CpxA proposed to function as a trans-membrane sensory protein (see Weber and Silverman, J. Mol. Biol. 203:467–478, 1988). This gene can be useful in manipulation the sensory apparatus related functions by deletion, addition or modification of the gene in transgenic bacteria, or as a drug target to interfere with bacterial signaling systems. May have utility as a controlled expression vector. |
| 134–213 | | Production of fine chemicals | These enzymes are useful for the synthesis of fine chemicals and may be used for the following applications: beer brewing, cheese ripening and flavors, cosmetics, detergents, flour and baked goods, fruit processing, leather processing, paper and textiles, silage and animal feed, starch processing, production of dextrins, glucose, fructose and other sweeteners, winemaking. |
| 399–401 | 411, 412 | Flavor, Bioactive peptide | PepV in related lactic acid bacteria act as intracellular dipeptidases (Hellendorn et al., J. Bacteriol. 179:3410–3415) and are important in the final breakdown of case in. PepV mutants exhibit slower growth rates in milk and alter some flavor characteristics |
| 402 | 413 | Flavor | Similar to heroin esterase, a serine esterase from Rhodococcus sp. strain H1 (Rathbone et al. Appl. |

TABLE 1-continued

| SEQ ID NO Polynucleotide | SEQ ID NO Polypeptide | Category | Gene function or protein class |
|---|---|---|---|
| | | | Environ. Microbiol. 63:2062–2066), contains consensus sequence for carboxylesterase serine-active site. Esterases are important for flavor determinants. |
| 403 | 414 | Immune modulation | Secreted lipoprotein isolated from *Mycobacterium tuberculosis* (Ashbridge et al. Nucleic. Acids Res. 17:1249–1253, 1989). Immunogenic, stimulates TH1-type T cell responses (Mohagheghpour el al., J. Immunol. 161:2400–2406, 1998). |
| 404 | 415 | Adhesion Immune modulation | Lectin-like surface-layer protein isolated from *Lactobacillus gasseri*. May have a role in intestinal adhesion via mucin-binding capability (Matsumura et al., J. Dairy Sci. 82:2523–2529, 1999). |
| 405 | 416 | Flavor | Large subunit of acetohydroxyacid synthase I, involved in branched chain amino acid synthesis. Branch chain amino acids impact on cheese flavor (Yvon et al., Appl. Environ. Microbiol. 63:414–419, 1997). |
| 406 | 417 | Flavor | Large subunit of acetolactate synthase II involved in branched chain amino acid synthesis. Branch chain amino acids impact on cheese flavor(Yvon et al., Appl. Environ. Microbiol. 63:414–419, 1997). |
| 26, 407 | 418, 419 | Multistress resistance, Flavor | Basic cell surface protein involved in L-cysteine uptake, also implicated in response to oxidative stress (Turner et al., J. Bacteriol. 181:2192–2198, 1999). |
| 408 | 420 | Immune modulation, Adhesion | Outer membrane lipoprotein, part of the NlpA family of lipoproteins |
| 409 | 421 | Multistress resistance | Induced by cold shock, binds DNA, necessary for low-temperature tolerance in *Bacillus subtilis* (Graumann et al., J. Bacteriol. 178:4611–4619, 1996). |
| 410 | 422 | Antibacterial Flavor, Anti-colon cancer | β-ketoacyl-acyl carrier protein involved in the synthesis of short chain fatty acids (Siggard-Andersen et al., Proc. Natl. Acad. Sci. USA 91:11027–11031, 1994), thought to Natl. Acad. Sci. USA 91:11027–11031, 1994), thought to have antibiotic effects and may be protective against colom cancer (Mortensen and Clausen, Scand. J. Gastroenterol. Suppl. 216:132–148, 1996). |

The inventive polynucleotide identified herein as SEQ ID NO: 31 shows some degree of homology to the previously identified peptidase pepO gene from Lactococcus (Tan et al., Appl. Environ. Microbiol. 57:3539–3599, 1991). PepO is a 70 kDa metallo-endopeptidase that hydrolyzes a range of polypeptides, including casein fragments. Peptidase pepO is believed to be a key enzyme in the cheese ripening process and contributes to flavor development as a cheese matures. The enzyme remains active under cheese conditions of reduced pH, high salt and low water activity where many other peptidases of lactic acid bacteria are inactivated. As detailed below, the polypeptide encoded by the inventive polynucleotide of SEQ ID NO: 31 (amino acid sequence provided in SEQ ID NO: 249) is effective in the hydrolysis of the milk protein, casein. The hydrolysis of milk caseins in cheese results in textural changes and the development of cheese flavors. The polypeptide of SEQ ID NO: 249, and compositions comprising this polypeptide and/or variants thereof, may thus be effectively employed in the enhancement of cheese flavors and textures.

Isolated polynucleotides of the present invention include the polynucleotides identified herein as SEQ ID NOS: 1–213 and 399–410; isolated polynucleotides comprising a polynucleotide sequence selected from the group consisting of SEQ ID NOS: 1–213 and 399–410; isolated polynucleotides comprising at least a specified number of contiguous residues (x-mers) of any of the polynucleotides identified as SEQ ID NOS: 1–213 and 399–410; isolated polynucleotides comprising a polynucleotide sequence that is complementary to any of the above polynucleotides; isolated polynucleotides comprising a polynucleotide sequence that is a reverse sequence or a reverse complement of any of the above polynucleotides; antisense sequences corresponding to any of the above polynucleotides; and variants of any of the above polynucleotides, as that term is described in this specification.

The word "polynucleotide(s)," as used herein, means a single or double stranded polymer of deoxyribonucleotide or ribonucleotide bases and includes DNA and corresponding RNA molecules, including mRNA molecules, both sense and antisense strands of DNA and RNA molecules, and comprehends cDNA, genomic DNA and recombinant DNA, as well as wholly or partially synthesized polynucleotides. A polynucleotide of the present invention may be an entire gene, or any portion thereof. A gene is a DNA sequence which codes for a functional protein or RNA molecule. Operable antisense polynucleotides may comprise a fragment of the corresponding polynucleotide, and the definition of "polynucleotide" therefore includes all operable antisense fragments. Antisense polynucleotides and techniques involving antisense polynucleotides are well known in the art and are described, for example, in Robinson-Benion, et al., "Antisense techniques," Methods in Enzymol. 254(23): 363–375, 1995; and Kawasaki, et al., Artific. Organs 20 (8): 836–848, 1996.

The definitions of the terms "complement," "reverse complement," and "reverse sequence," as used herein, are best illustrated by the following examples. For the sequence 5' AGGACC 3', the complement, reverse complement, and reverse sequences are as follows:

| | |
|---|---|
| complement | 3' TCCTGG 5' |
| reverse complement | 3' GGTCCT 5' |
| reverse sequence | 5' CCAGGA 3' |

Identification of genomic DNA and heterologous species DNA can be accomplished by standard DNA/DNA hybridization techniques, under appropriately stringent conditions, using all or part of a DNA sequence as a probe to screen an appropriate library. Alternatively, PCR techniques using oligonucleotide primers that are designed based on known DNA and protein sequences can be used to amplify and identify other identical or similar DNA sequences. Synthetic DNA corresponding to the identified sequences or variants thereof may be produced by conventional synthesis methods. All of the polynucleotides described herein are isolated and purified, as those terms are commonly used in the art.

The polynucleotides identified as SEQ ID NOS: 1–213 and 399–410 may contain open reading frames ("ORFs"), or partial open reading frames, encoding polypeptides. Additionally, polynucleotides identified as SEQ ID NOS: 1–213 and 399–410 may contain non-coding sequences such as promoters and terminators that may be useful as control elements. Additionally, open reading frames encoding polypeptides may be identified in extended or full-length sequences corresponding to the sequences set out as SEQ ID NOS: 214–398 and 411–422. Open reading frames may be identified using techniques that are well known in the art. These techniques include, for example, analysis for the location of known start and stop codons, most likely reading frame identification based on codon frequencies, similarity to known bacterial expressed genes, etc. Suitable tools and software for ORF analysis are available, for example, on the Internet. Additional tools and software suitable for ORF analysis, include GeneWise (The Sanger Center, Wellcome Trust Genome Campus, Hinxton, Cambridge CB10 lSA, United Kingdom), Diogenes (Computational Biology Centers, University of Minnesota, Academic Health Center, UMHG Box 43 Minneapolis Minn. 55455), and GRAIL (Informatics Group, Oak Ridge National Laboratories, Oak Ridge, Tenn., TN). Open reading frames and portions of open reading frames may be identified in the polynucleotides of the present invention. Once a partial open reading frame is identified, the polynucleotide may be extended in the area of the partial open reading frame using techniques that are well known in the art until the polynucleotide for the full open reading frame is identified. Thus, polynucleotides and open reading frames encoding polypeptides may be identified using the polynucleotides of the present invention.

Once open reading frames are identified in the polynucleotides of the present invention, the open reading frames may be isolated and/or synthesized. Expressible genetic constructs comprising the open reading frames and suitable promoters, initiators, terminators, etc., which are well known in the art, may then be constructed. Such genetic constructs may be introduced into a host cell to express the polypeptide encoded by the open reading frame. Suitable host cells may include various prokaryotic and eukaryotic cells. In vitro expression of polypeptides is also possible, as well known in the art.

As used herein, the term "oligonucleotide" refers to a relatively short segment of a polynucleotide sequence, generally comprising between 6 and 60 nucleotides, and comprehends both probes for use in hybridization assays and primers for use in the amplification of DNA by polymerase chain reaction.

As used herein, the term "x-mer," with reference to a specific value of "x," refers to a polynucleotide comprising at least a specified number ("x") of contiguous residues of any of the polynucleotides identified as SEQ ID NOS: 1–213 and 399–410. The value of x may be from about 20 to about 600, depending upon the specific sequence.

In another aspect, the present invention provides isolated polypeptides encoded, or partially encoded, by the above polynucleotides. As used herein, the term "polypeptide" encompasses amino acid chains of any length, including full-length proteins, wherein the amino acid residues are linked by covalent peptide bonds. The term "polypeptide encoded by a polynucleotide" as used herein, includes polypeptides encoded by a polynucleotide which comprises an isolated polynucleotide sequence or variant provided herein. Polypeptides of the present invention may be naturally purified products, or may be produced partially or wholly using recombinant techniques. Such polypeptides may be glycosylated with bacterial, fungal, mammalian or other eukaryotic carbohydrates or may be non-glycosylated.

Polypeptides of the present invention may be produced recombinantly by inserting a polynucleotide that encodes the polypeptide into an expression vector and expressing the polypeptide in an appropriate host. Any of a variety of expression vectors known to those of ordinary skill in the art may be employed. Expression may be achieved in any appropriate host cell that has been transformed or transfected with an expression vector containing a polypeptide encoding a recombinant polypeptide. Suitable host cells include prokaryotes, yeast and higher eukaryotic cells. Preferably, the host cells employed are *Escherichia coli*, *Lactococcus lactis*, Lactobacillus, insect, yeast or a mammalian cell line such as COS or CHO. The polynucleotide(s) expressed in this manner may encode naturally occurring polypeptides, portions of naturally occurring polypeptides, or other variants thereof.

In a related aspect, polypeptides are provided that comprise at least a functional portion of a polypeptide having an amino acid sequence encoded by a polynucleotide of the present invention. As used herein, a "functional portion" of a polypeptide is that portion which contains the active site essential for affecting the function of the polypeptide, for example, the portion of the molecule that is capable of binding one or more reactants. The active site may be made up of separate portions present on one or more polypeptide chains and will generally exhibit high binding affinity.

Functional portions of a polypeptide may be identified by first preparing fragments of the polypeptide by either chemical or enzymatic digestion of the polypeptide, or by mutation analysis of the polynucleotide that encodes the polypeptide and subsequent expression of the resulting mutant polypeptides. The polypeptide fragments or mutant polypeptides are then tested to determine which portions retain biological activity, using, for example, the representative assays provided below.

Portions and other variants of the inventive polypeptides may be generated by synthetic or recombinant means. Synthetic polypeptides having fewer than about 100 amino acids, and generally fewer than about 50 amino acids, may be generated using techniques that are well known to those of ordinary skill in the art. For example, such polypeptides may be synthesized using any of the commercially available solid-phase techniques, such as the Merrifield solid-phase synthesis method, where amino acids are sequentially added to a growing amino acid chain (See Merrifield, *J. Am. Chem. Soc.* 85:2149–2154, 1963). Equipment for automated synthesis of polypeptides is commercially available from suppliers such as Perkin Elmer/Applied Biosystems, Inc. (Foster City, Calif.), and may be operated according to the manufacturer's instructions. Variants of a native polypeptide may be prepared using standard mutagenesis techniques, such as oligonucleotide-directed site-specific mutagensis (Kunkel, *Proc. Natl. Acad. Sci. USA* 82: 488–492, 1985). Sections of DNA sequences may also be removed using standard techniques to permit preparation of truncated polypeptides.

In general, the polypeptides disclosed herein are prepared in an isolated, substantially pure form. Preferably, the polypeptides are at least about 80% pure; more preferably at least about 90% pure; and most preferably at least about 99% pure.

As used herein, the term "variant" comprehends polynucleotide or polypeptide sequences different from the specifically identified sequences, wherein one or more nucleotides or amino acid residues is deleted, substituted, or added. Variants may be naturally occurring allelic variants, or non-naturally occurring variants. Variant polynucleotide sequences preferably exhibit at least 40%, more preferably at least 60%, more preferably yet at least 75%, and most preferably at least 90% identity to a sequence of the present invention. Variant polypeptide sequences preferably exhibit at least 50%, more preferably at least 75%, more preferably yet at least 90%, and most preferably at least 95% identity to a sequence of the present invention. The percentage identity is determined by aligning the two sequences to be compared as described below, determining the number of identical residues in the aligned portion, dividing that number by the total number of residues in the inventive (queried) sequence, and multiplying the result by 100.

Polynucleotide and polypeptide sequences may be aligned, and the percentage of identical residues in a specified region may be determined against another polynucleotide or polypeptide, using computer algorithms that are publicly available. Two exemplary algorithms for aligning and identifying the similarity of polynucleotide sequences are the BLASTN and FASTA algorithms. Polynucleotides may also be analyzed using the BLASTX algorithm, which compares the six-frame conceptual translation products of a nucleotide query sequence (both strands) against a protein sequcence database. The percentage identity of polypeptide sequences may be examined using the BLASTP algorithm. The BLASTN, BLASTX and BLASTP programs are available from the National Center for Biotechnology Information (NCBI), National Library of Medicine, Building 38A, Room 8N805, Bethesda, Md. 20894, USA. The BLASTN algorithm Version 2.0.4 [Feb. 24, 1998], Version 2.0.6 [Sep. 16, 1998] and Version 2.0.11 [Jan. 20, 2000], set to the parameters described below, is preferred for use in the determination of polynucleotide variants according to the present invention. The BLASTP algorithm, set to the parameters described below, is preferred for use in the determination of polypeptide variants according to the present invention. The use of the BLAST family of algorithms, including BLASTN, BLASTP and BLASTX, is described at NCBI's website and in the publication of Altschul, et al., *Nucleic Acids Res.* 25: 3389–3402, 1997.

The computer algorithm FASTA is available on the Internet and from the University of Virginia by contacting David Hudson, Vice Provost for Research, University of Virginia, P.O. Box 9025, Charlottesville, Va. 22906-9025, USA. FASTA Version 2;0u4 [February 1996], set to the default parameters described in the documentation and distributed with the algorithm, may be used in the determination of variants according to the present invention. The use of the FASTA algorithm is described in Pearson and Lipman, *Proc. Natl. Acad. Sci. USA* 85:2444–2448, 1988; and Pearson, *Methods in Enzymol.* 183: 63–98, 1990.

The following running parameters are preferred for determination of alignments and similarities using BLASTN that contribute to the E values and percentage identity for polynucleotide sequences: Unix running command: blastall -p blastn -d embldb -e 10-G0 -E0-r 1 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (BLASTN only) [Integer]; -v Number of one-line descriptions (V) [Integer]; -b Number of alignments to show (B) [Integer]; -i Query File [File In]; and -o BLAST report Output File [File Out] Optional.

The following running parameters are preferred for determination of alignments and similarities using BLASTP that contribute to the E values and percentage identity of polypeptide sequences: blastall -p blastp -d swissprotdb -e 10 -G 0 -E 0 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional. The "hits" to one or more database sequences by a queried sequence produced by BLASTN, FASTA, BLASTP or a similar algorithm, align and identify similar portions of sequences. The hits are arranged in order of the degree of similarity and the length of sequence overlap. Hits to a database sequence generally represent an overlap over only a fraction of the sequence. length of the queried sequence.

The BLASTN, FASTA, and BLASTP algorithms also produce "Expect" values for alignments. The Expect value (E) indicates the number of hits one can "expect" to see over a certain number of contiguous sequences by chance when searching a database of a certain size. The Expect value is used as a significance threshold for determining whether the hit to a database, such as the preferred EMBL database, indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the polynucleotide sequences then have a probability of 90% of being the same. For sequences having an E value of 0.01 or less over aligned and matched portions, the probability of finding a match by chance in the EMBL database is 1% or less using the BLASTN or FASTA algorithm.

According to one embodiment, "variant" polynucleotides and polypeptides, with reference to each of the polynucleotides and polypeptides of the present invention, preferably comprise sequences producing an E value of 0.01 or less when compared to the polynucleotide or polypeptide of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described above. According to a preferred embodiment, a variant polynucleotide is a sequence having the same number or fewer nucleic acids than a polynucleotide of the present invention that has at least a 99% probability of being the same as the polynucleotide of the present invention, measured as having an E value of 0.01 or less using the BLASTN or FASTA algorithms set at parameters described above. Similarly, according to a preferred embodiment, a variant polypeptide is a sequence having the same number or fewer amino acids than a polypeptide of the present invention that has at least a 99% probability of being the same as a polypeptide of the present invention, measured as having an E value of 0.01 or less using the BLASTP algorithm set at the parameters described above.

As noted above, the percentage identity is determined by aligning sequences using one of the BLASTN, FASTA, or BLASTP algorithms, set at the running parameters described above, and identifying the number of identical nucleic or amino acids over the aligned portions; dividing the number of identical nucleic or amino acids by the total number of nucleic or amino acids of the polynucleotide or polypeptide sequence of the present invention; and then multiplying by 100 to determine the percentage identity. For example, a polynucleotide of the present invention having 220 nucleic acids has a hit to a polynucleotide sequence in the EMBL database having 520 nucleic acids over a stretch of 23 nucleotides in the alignment produced by the BLASTN algorithm using the parameters described above. The 23 nucleotide hit includes 21 identical nucleotides, one gap and one different nucleotide. The percentage identity of the polynucleotide of the present invention to the hit in the EMBL library is thus 21/220 times 100, or 9.5%. The polynucleotide sequence in the EMBL database is thus not a variant of a polynucleotide of the present invention.

In addition to having a specified percentage identity to an inventive polynucleotide or polypeptide sequence, variant polynucleotides and polypeptides preferably have additional structure and/or functional features in common with the inventive polynucleotide or polypeptide. Polypeptides having a specified degree of identity to a polypeptide of the present invention share a high degree of similarity in their primary structure and have substantially similar functional properties. In addition to sharing a high degree of similarity in their primary structure to polynucleotides of the present invention, polynucleotides having a specified degree of identity to, or capable of hybridizing to an inventive polynucleotide preferably have at least one of the following features: (i) they contain an open reading frame or partial open reading frame encoding a polypeptide having substantially the same functional properties as the polypeptide encoded by the inventive polynucleotide; or (ii) they contain identifiable domains in common.

Alternatively, variant polynucleotides of the present invention hybridize to the polynucleotide sequences recited in SEQ ID NOS: 1–213 and 399–410, or complements, reverse sequences, or reverse complements of those sequences under stringent conditions. As used herein, "stringent conditions" refers to prewashing in a solution of 6×SSC, 0.2% SDS; hybridizing at 65° C., 6×SSC, 0.2% SDS overnight; followed by two washes of 30 minutes each in 1×SSC, 0.1% SDS at 65° C. and two washes of 30 minutes each in 0.2×SSC, 0.1% SDS at 65° C.

The present invention also encompasses polynucleotides that differ from the disclosed sequences but that, as a consequence of the discrepancy of the genetic code, encode a polypeptide having similar enzymatic activity as a polypeptide encoded by a polynucleotide of the present invention. Thus, polynucleotides comprising sequences that differ from the polynucleotide sequences recited in SEQ ID NOS: 1–213 and 399–410, or complements, reverse sequences, or reverse complements of those sequences as a result of conservative substitutions are encompassed within the present invention. Additionally, polynucleotides comprising sequences that differ from the inventive polynucleotide sequences or complements, reverse complements, or reverse sequences as a result of deletions and/or insertions totaling less than 10% of the total sequence length are also contemplated by and encompassed within the present invention. Similarly, polypeptides comprising sequences that differ from the inventive polypeptide sequences as a result of amino acid substitutions, insertions, and/or deletions totaling less than 10% of the total sequence length are contemplated by and encompassed within the present invention, provided the variant polypeptide has similar activity to the inventive polypeptide.

The polynucleotides of the present invention may be isolated from various libraries, or may be synthesized using techniques that are well known in the art. The polynucleotides may be synthesized, for example, using automated oligonucleotide synthesizers (e.g., Beckman Oligo 1000M DNA Synthesizer) to obtain polynucleotide segments of up to 50 or more nucleic acids. A plurality of such polynucleotide segments may then be ligated using standard DNA manipulation techniques that are well known in the art of molecular biology. One conventional and exemplary polynucleotide synthesis technique involves synthesis of a single stranded polynucleotide segment having, for example, 80 nucleic acids, and hybridizing that segment to a synthesized complementary 85 nucleic acid segment to produce a 5-nucleotide overhang. The next segment may then be synthesized in a similar fashion, with a 5-nucleotide overhang on the opposite strand. The "sticky" ends ensure proper ligation when the two portions are hybridized. In this way, a complete polynucleotide of the present invention may be synthesized entirely in vitro.

Certain of the polynucleotides identified as SEQ ID NOS: 1–213 and 399–410 are generally referred to as "partial" sequences, in that they do not represent the full coding portion of a gene encoding a naturally occurring polypeptide. The partial polynucleotide sequences disclosed herein may be employed to obtain the corresponding full-length genes for various species and organisms by, for example, screening DNA expression libraries using hybridization probes based on the polynucleotides of the present invention, or using PCR amplification with primers based upon the polynucleotides of the present invention. In this way one can, using methods well known in the art, extend a polynucleotide of the present invention upstream and downstream of the corresponding DNA, as well as identify the corresponding mRNA and genomic DNA, including the promoter and enhancer regions, of the complete gene. The present invention thus comprehends isolated polynucleotides comprising a sequence identified in SEQ ID NOS: 1–213 and 399–410, or a variant of one of the specified sequences, that encode a functional polypeptide, including full length genes. Such extended polynucleotides may have a length of from about 50 to about 4,000 nucleic acids or base pairs, and preferably have a length of less than about 4,000 nucleic acids or base pairs, more preferably yet a length of less than about 3,000 nucleic acids or base pairs, more preferably yet a length of less than about 2,000 nucleic acids or base pairs. Under some circumstances, extended polynucleotides of the present invention may have a length of less than about 1,800 nucleic acids or base pairs, preferably less than about 1,600 nucleic acids or base pairs, more preferably less than about 1,400 nucleic acids or base pairs, more preferably yet less than about 1,200 nucleic acids or base pairs, and most preferably less than about 1,000 nucleic acids or base pairs.

Polynucleotides of the present invention comprehend polynucleotides comprising at least a specified number of contiguous residues (x-mers) of any of the polynucleotides identified as SEQ ID NOS: 1–213 and 399–410 or their variants. According to preferred embodiments, the value of x is preferably at least 20, more preferably at least 40, more preferably yet at least 60, and most preferably at least 80. Thus, polynucleotides of the present invention include polynucleotides comprising a 20-mer, a 40-mer, a 60-mer, an 80-mer, a 100-mer, a 120-mer, a 150-mer, a 180-mer, a 220-mer a 250-mer, or a 300-mer, 400-mer, 500-mer or 600-mer of a polynucleotide identified as SEQ ID NOS: 1–213 and 399–410 or a variant of one of the polynucleotides identified as SEQ ID NOS: 1–213 and 399–410.

Oligonucleotide probes and primers complementary to and/or corresponding to SEQ ID NOS: 1–213 and 399–410, and variants of those sequences, are also comprehended by the present invention. Such oligonucleotide probes and primers are substantially complementary to the polynucleotide of interest. An oligonucleotide probe or primer is described as "corresponding to" a polynucleotide of the present invention, including one of the sequences set out as SEQ ID NOS: 1–213 and 399–410 or a variant, if the oligonucleotide probe or primer, or its complement, is contained within one of the sequences set out as SEQ ID NOS: 1–213 and 399–410 or a variant of one of the specified sequences.

Two single stranded sequences are said to be substantially complementary when the nucleotides of one strand, optimally aligned and compared, with the appropriate nucleotide insertions and/or deletions, pair with at least 80%, preferably at least 90% to 95%, and more preferably at least 98% to 100%, of the nucleotides of the other strand. Alternatively, substantial complementarity exists when a first DNA strand will selectively hybridize to a second DNA strand under stringent hybridization conditions. Stringent hybridization conditions for determining complementarity include salt conditions of less than about 1 M, more usually less than about 500 mM and preferably less than about 200 mM. Hybridization temperatures can be as low as 5° C., but are generally greater than about 22° C., more preferably greater than about 30° C. and most preferably greater than about 37° C. Longer DNA fragments may require higher hybridization temperatures for specific hybridization. Since the stringency of hybridization may be affected by other factors such as probe composition, presence of organic solvents and extent of base mismatching, the combination of parameters is more important than the absolute measure of any one alone. DNA-DNA hybridization studies may performed using either genomic DNA or DNA derived by preparing cDNA from the RNA present in a sample to be tested.

In addition to DNA-DNA hybridization, DNA-RNA or RNA-RNA hybridization assays are also possible. In the first case, the mRNA from expressed genes would then be detected instead of genomic DNA or cDNA derived from mRNA of the sample. In the second case, RNA probes could be used. In addition, artificial analogs of DNA hybridizing specifically to target sequences could also be used.

In specific embodiments, the oligonucleotide probes and/or primers comprise at least about 6 contiguous residues, more preferably at 1 cast about 10 contiguous residues, and most preferably at least about 20 contiguous residues complementary to a polynucleotide sequence of the present invention. Probes and primers of the present invention may be from about 8 to 100 base pairs in length or, preferably from about 10 to 50 base pairs in length or, more preferably from about 15 to 40 base pairs in length. The primers and probes may be readily selected using procedures well known in the art, taking into account DNA-DNA hybridization stringencies, annealing and melting temperatures, potential for formation of loops and other factors, which are well known in the art. Tools and software suitable for designing probes, and especially suitable for designing PCR primers, are available on the Internet, for example. In addition, a software program suitable for designing probes, and especially for designing PCR primers, is available from Premier Biosoft International, 3786 Corina Way, Palo Alto, Calif. 94303-4504. Preferred techniques for designing PCR primers are also disclosed in Dieffenbach and Dyksler, *PCR primer: a laboratory manual*, CSHL Press: Cold Spring Harbor, N.Y., 1995.

A plurality of oligonucleotide probes or primers corresponding to a polynucleotide of the present invention may be provided in a kit form. Such kits generally comprise multiple DNA or oligonucleotide probes, each probe being specific for a polynucleotide sequence. Kits of the present invention may comprise one or more probes or primers corresponding to a polynucleotide of the present invention, including a polynucleotide sequence identified in SEQ ID NOS: 1–213 and 399–410.

In one embodiment useful for high-throughput assays, the oligonucleotide probe kits of the present invention comprise multiple probes in an array format, wherein each probe is immobilized in a predefined, spatially addressable location on the surface of a solid substrate. Array formats which may be usefully employed in the present invention are disclosed, for example, in U.S. Pat. Nos. 5,412,087, 5,545,531, and PCT Publication No. WO 95/00530, the disclosures of which are hereby incorporated by reference.

Oligonucleotide probes for use in the present invention may be constructed synthetically prior to immobilization on an array, using techniques well known in the art (See, for example, Gait, ed., *Oligonucleotide synthesis a practical approach*, IRL Press: Oxford, England, 1984). Automated equipment for the synthesis of oligonucleotides is available commercially from such companies as Perkin Elmer/Applied Biosystems Division (Foster City, Calif.) and may be operated according to the manufacturer's instructions. Alternatively, the probes may be constructed directly on the surface of the array using techniques taught, for example, in PCT Publication No. WO 95/00530.

The solid substrate and the surface thereof preferably form a rigid support and are generally formed from the same material. Examples of materials from which the solid substrate may be constructed include polymers, plastics, resins, membranes, polysaccharides, silica or silica-based materials, carbon, metals and inorganic glasses. Synthetically prepared probes may be immobilized on the surface of the solid substrate using techniques well known in the art, such as those disclosed in U.S. Pat. No. 5,412,087.

In one such technique, compounds having protected functional groups, such as thiols protected with photochemically removable protecting groups, are attached to the surface of the substrate. Selected regions of the surface are then irradiated with a light source, preferably a laser, to provide reactive thiol groups. This irradiation step is generally performed using a mask having apertures at predefined locations using photolithographic techniques well known in the art of semiconductors. The reactive thiol groups are then incubated with the oligonucleotide probe to be immobilized. The precise conditions for incubation, such as temperature, time and pH, depend on the specific probe and can be easily determined by one of skill in the art. The surface of the substrate is washed free of unbound probe and the irradiation step is repeated using a second mask having a different pattern of apertures. The surface is subsequently incubated with a second, different, probe. Each oligonucleotide probe is typically immobilized in a discrete area of less than about 1 mm². Preferably each discrete area is less than about 10,000 mm², more preferably less than about 100 mm². In this manner, a multitude of oligonucleotide probes may be immobilized at predefined locations on the array.

The resulting array may be employed to screen for differences in organisms or samples or products containing genetic material as follows. Genomic or cDNA libraries are prepared using techniques well known in the art. The resulting target DNA is then labeled with a suitable marker, such as a radiolabel, chromophore, fluorophore or chemiluminescent agent, using protocols well known for those skilled in the art. A solution of the labeled target DNA is contacted with the surface of the array and incubated for a suitable period of time.

The surface of the array is then washed free of unbound target DNA and the probes to which the target DNA hybridized are determined by identifying those regions of the array to which the markers are attached. When the marker is a radiolabel, such as $^{32}P$, autoradiography is employed as the detection method. In one embodiment, the marker is a fluorophore, such as fluorescein, and the location of bound target DNA is determined by means of fluorescence spectroscopy. Automated equipment for use in fluorescence scanning of oligonucleotide probe arrays is available from Affymetrix, Inc. (Santa Clara, Calif.) and may be operated according to the manufacturer's instructions. Such equipment may be employed to determine the intensity of fluorescence at each predefined location on the array, thereby providing a measure of the amount of target DNA bound at each location. Such an assay would be able to indicate not only the absence and presence of the marker probe in the target, but also the quantitative amount as well.

The significance of such high-throughput screening system is apparent for applications such as microbial selection and quality control operations in which there is a need to identify large numbers of samples or products for unwanted materials, to identify microbes or samples or products containing microbial material for quarantine purposes, etc., or to ascertain the true origin of samples or products containing microbes. Screening for the presence or absence of polynucleotides of the present invention used as identifiers for tagging microbes and microbial products can be valuable for later detecting the genetic composition of food, fermentation and industrial microbes or microbes in human or animal digestive system after consumption of probiotics, etc.

In this manner, oligonucleotide probe kits of the present invention may be employed to examine the presence/absence (or relative amounts in case of mixtures) of polynucleotides in different samples or products containing different materials rapidly and in a cost-effective manner. Examples of microbial species which may be examined using the present invention, include lactic acid bacteria, such as *Lactobacillus rhamnosus*, and other microbial species.

Another aspect of the present invention involves collections of a plurality of polynucleotides of the present invention. A collection of a plurality of the polynucleotides of the present invention, particularly the polynucleotides identified as SEQ ID NOS: 1–213 and 399–410, may be recorded and/or stored on a storage medium and subsequently accessed for purposes of analysis, comparison, etc. Suitable storage media include magnetic media such as magnetic diskettes, magnetic tapes, CD-ROM storage media, optical storage media, and the like. Suitable storage media and methods for recording and storing information, as well as accessing information such as polynucleotide sequences recorded on such media, are well known in the art. The polynucleotide information stored on the storage medium is preferably computer-readable and may be used for analysis and comparison of the polynucleotide information.

Another aspect of the present invention thus involves storage medium on which are recorded a collection of the polynucleotides of the present invention, particularly a collection of the polynucleotides identified as SEQ ID NOS: 1–213 and 399–410. According to one embodiment, the storage medium includes a collection of at least 20, preferably at least 50, more preferably at least 100, and most preferably at least 200 of the polynucleotides of the present invention, preferably the polynucleotides identified as SEQ ID NOS: 1–213 and 399–410, including variants of those polynucleotides.

Another aspect of the present invention involves a combination of polynucleotides, the combination containing at least 5, preferably at least 10, more preferably at least 20, and most preferably at least 50 different polynucleotides of the present invention, including polynucleotides selected from SEQ ID NOS: 1–213 and 399–410, and variants of these polynucleotides.

In another aspect, the present invention provides genetic constructs comprising, in the 5'-3' direction, a gene promoter sequence; and an open reading frame coding for at least a functional portion of a polypeptide encoded by a polynucleotide of the present invention. In certain embodiments, the genetic constructs of the present invention also comprise a gene termination sequence. The open reading frame may be oriented in either a sense or antisense direction. Genetic constructs comprising a non-coding region of a gene coding for a polypeptide encoded by the above polynucleotides or a nucleotide sequence complementary to a non-coding region, together with a gene promoter sequence, are also provided. A terminator sequence may form part of this construct. Preferably, the gene promoter and termination sequences are functional in a host organism. More preferably, the gene promoter and termination sequences are common to those of the polynucleotide being introduced. The genetic construct may further include a marker for the identification of transformed cells.

Techniques for operatively linking the components of the genetic constructs are well known in the art and include the use of synthetic linkers containing one or more restriction endonuclease sites as described, for example, by Sambrook et al., in *Molecular cloning: a laboratory manual*, Cold Spring Harbor Laboratories Press: Cold Spring Harbor, N.Y., 1989. The genetic constructs of the present invention may be linked to a vector having at least one replication system, for example, *E. coli*, whereby after each manipulation, the resulting construct can be cloned and sequenced and the correctness of the manipulation determined.

Transgenic microbial cells comprising the genetic constructs of the present invention are also provided by the present invention, together with microbes comprising such transgenic cells, products and progeny of such microbes, and materials including such microbes. Techniques for stably incorporating genetic constructs into the genome of target microbes, such as Lactobacillus species, *Lactococcus lactis* or *E. coli*, are well known in the art of bacterial transformation and are exemplified by the transformation of *E. coli* for sequencing in Example 1.

Transgenic, non-microbial, cells comprising the genetic constructs of the present invention are also provided, together with organisms comprising such transgenic cells, and products and progeny of such organisms. Genetic constructs of the present invention may be stably incorporated into the genomes of non-microbial target organisms, such as fungi, using techniques well known in the art.

In preferred embodiments, the genetic constructs of the present invention are employed to transform microbes used in the production of food products, ingredients, processing aids, additives or supplements and for the production of microbial products for pharmaceutical uses, particularly for modulating immune system function and immunological effects; and in the production of chemoprotectants providing beneficial effects, probiotics and health supplements. The inventive genetic constructs may also be employed to transform bacteria that are used to produce enzymes or substances such as polysaccharides, flavor compounds, and bioactive substances, and to enhance resistance to industrial processes such as drying and to adverse stimuli in the human digestive system. The genes involved in antibiotic production, and phage uptake and resistance in *Lactobacillus rhamnosus* are considered to be especially useful. The target microbe to be used for transformation with one or more polynucleotides or genetic constructs of the present invention is preferably selected from the group consisting of bacterial genera Lactococcus, Lactobacillus, Streptococcus, Oenococcus, Lactosphaera, Trichococcus, Pediococcus and others potentially useful in various fermentation industries selected, most preferably, from the group consisting of Lactobacillus species in the following list: *Lactobacillus acetotolerans, Lactobacillus acidophilus, Lactobacillus agilis, Lactobacillus alimentarius, Lactobacillus amylolyticus, Lactobacillus amylophilus, Lactobacillus amylovorus, Lactobacillus animalis, Lactobacillus arizonae, Lactobacillus aviarius, Lactobacillus bavaricus, Lactobacillus bifermentans, Lactobacillus brevis, Lactobacillus buchneri, Lactobacillus bulgaricus, Lactobacillus casei, Lactobacillus collinoides, Lactobacillus coryniformis, Lactobacillus crispatus, Lactobacillus curvatus, Lactobacillus delbrueckii, Lactobacillus delbrueckii* subsp. *bulgaricus, Lactobacillus delbrueckii* subsp. *lactis, Lactobacillus farciminis, Lactobacillus fermentum, Lactobacillus fructivorans, Lactobacillus gallinarum, Lactobacillus gasseri, Lactobacillus graminis, Lactobacillus hamsteri, Lactobacillus helveticus, Lactobacillus helveticus* subsp. *jugurti, Lactobacillus hetero, Lactobacillus hilgardii, Lactobacillus homohiochii, Lactobacillus japonicus, Lactobacillus johnsonii, Lactobacillus kefiri, Lactobacillus lactis, Lactobacillus leichmannii, Lactobacillus lindneri, Lactobacillus mali, Lactobacillus maltaromicus, Lactobacillus manihotivorans, Lactobacillus mucosae, Lactobacillus murinus, Lactobacillus oris, Lactobacillus panis, Lactobacillus paracasei, Lactobacillus paracasei* subsp. *pseudoplantarum, Lactobacillus paraplantarum, Lactobacillus pentosus, Lactobacillus plantarum, Lactobacillus pontis, Lactobacillus reuteri, Lactobacillus rhamnosus, Lactobacillus ruminis, Lactobacillus sake, Lactobacillus salivarius, Lactobacillus salivarius* subsp. *salicinius, Lactobacillus salivarius* subsp. *salivarius, Lactobacillus sanfranciscensis, Lactobacillus sharpeae, Lactobacillus thermophilus, Lactobacillus vaginalis, Lactobacillus vermiforme, Lactobacillus zeae*.

In yet a further aspect, the present invention provides methods for modifying the concentration, composition and/or activity of a polypeptide in a host organism, such as a microbe, comprising stably incorporating a genetic construct of the present invention into the genome of the host organism by transforming the host organism with such a genetic construct. The genetic constructs of the present invention may be used to transform a variety of organisms. Organisms which may be transformed with the inventive constructs include plants, such as monocotyledonous angiosperms (e.g., grasses, corn, grains, oat, wheat and barley); dicotyledonous angiosperms (e.g., Arabidopsis, tobacco, legumes, alfalfa, oaks, eucalyptus, maple); gymnosperms, (e.g., Scots pine (Aronen, *Finnish Forest Res. Papers, Vol.* 595, 1996); white spruce (Ellis et al., *Biotechnology* 11:84–89, 1993); and larch (Huang, et al., *In Vitro Cell* 27:201–207, 1991); and any kind of plant amenable to genetic engineering.

Thus, in yet another aspect, transgenic plant cells comprising the genetic constructs of the present invention are provided, together with plants comprising such transgenic cells, and fruits, seeds, products and progeny of such plants. Techniques for stably incorporating genetic constructs into the genome of target organisms, such as plants, are well known in the art and include *Agrobacterium tumefaciens* mediated introduction, electroporation, protoplast fusion, injection into reproductive organs, injection into immature embryos, high velocity projectile introduction and the like. The choice of technique will depend upon the target plant to be transformed. For examnple, dicotyledonous plants and certain monocots and gymnosperms may be transformed by Agrobacterium Ti plasmid technology, as described, for example by Bevan, *Nucleic Acids Res.* 12:8711–8721, 1984. Targets for the introduction of the genetic constructs include tissues, such as leaf tissue, disseminated cells, protoplasts, seeds, embryos, meristematic regions; cotyledons, hypocotyls, and the like.

Once the cells are transformed, cells having the genetic construct incorporated in their genome are selected. Transgenic cells may then be cultured in an appropriate medium, using techniques well known in the art. In the case of protoplasts, the cell wall is allowed to reform under appropriate osmotic conditions. In the case of seeds or embryos, an appropriate germination or callus initiation medium is employed. For explants, an appropriate regeneration medium is used. Regeneration of plants is well established for many species. For a review of regeneration of forest trees, see Dunstan et al., "Somatic embryogenesis in woody plants," in Thorpe, T. A., ed., *In vitro embryogenesis of plants*, (*Current Plant Science and Biotechnology in Agriculture*), 20(12):471–540, 1995. Specific protocols for the regeneration of spruce are discussed by Roberts et al. ("Somatic embryogenesis of Spruce," in Redenbaugh K., ed., *Synseed: applications of synthetic seed to crop improvement*, CRC Press: Ch.23:427–449, 1993). The resulting transformed plants may be reproduced sexually or asexually, using methods well known in the art, to give successive generations of transgenic plants and practically unlimited amounts of tagged plant-derived products.

The polynucleotides of the present invention may be further employed as non-disruptive tags for marking organisms, particularly microbes. Other organisms may, however, be tagged with the polynucleotides of the present invention, including commercially valuable plants, animals, fish, fungi and yeasts. Genetic constructs comprising polynucleotides of the present invention may be stably introduced into an organism as heterologous, non-functional, non-disruptive tags. It is then possible to identify the origin or source of the organism at a later date by determining the presence or absence of the tag(s) in a sample of material. Detection of the tag(s) may be accomplished using a variety of conventional techniques, and will generally involve the use of nucleic acid probes. Sensitivity in assaying the presence of probe can be usefully increased by using branched oligonucleotides, as described by Horn et al., Nucleic Acids Res. 25(23):4842–4849, 1997, enabling detection of as few as 50 DNA molecules in the sample.

Polynucleotides of the present invention may also be used to specifically suppress gene expression by methods such as RNA interference (RNAi), which may also include cosuppression and quelling. This and other techniques of gene suppression are well known in the art. A review of this technique is found in Science 288:1370–1372, 2000. Traditional methods of gene suppression, employing antisense RNA or DNA, operate by binding to the reverse sequence of a gene of interest such that binding interferes with subsequent cellular processes and thereby blocks synthesis of the corresponding protein. RNAi also operates on a post-transcriptional level and is sequence specific, but suppresses gene expression far more efficiently Studies have demonstrated that one or more ribonucleases specifically bind to and cleave double-stranded RNA into short fragments. The ribonuclease(s) remains associated with these fragments, which in turn specifically bind to complementary mRNA, i.e. specifically bind to the transcribed mRNA strand for the gene of interest. The mRNA for the gene is also degraded by the ribonuclease(s) into short fragments, thereby obviating translation and expression of the gene. Additionally, an RNA polymerase may act to facilitate the synthesis of numerous copies of the short fragments, which exponentially increases the efficiency of the system. A unique feature of this gene suppression pathway is that silencing is not limited to the cells where it is initiated. The gene-silencing effects may be disseminated to other parts of an organism and even transmitted through the germ line to several generations.

Specifically, polynucleotides of the present invention are useful for generating gene constructs for silencing specific genes. Polynucleotides of the present invention may be used to generate genetic constructs that encode a single self-complementary RNA sequence specific for one or more genes of interest. Genetic constructs and/or gene-specific self-complementary RNA sequences may be delivered by any conventional method known in the art. Within genetic constructs, sense and antisense sequences flank an intron sequence arranged in proper splicing orientation making use of donor and acceptor splicing sites. Alternative methods may employ spacer sequences of various lengths rather than discrete intron sequences to create an operable and efficient construct. During post-transcriptional processing of the gene construct product, intron sequences are spliced-out, allowing sense and antisense sequences, as well as splice junction sequences, to bind forming double-stranded RNA. Select ribonucleases bind to and cleave the double-stranded RNA, thereby initiating the cascade of events leading to degradation of specific mRNA gene sequences, and silencing specific genes. Alternatively, rather than using a gene construct to express the self-complementary RNA sequences, the gene-specific double-stranded RNA segments are delivered to one or more targeted areas to be internalized into the cell cytoplasm to exert a gene silencing effect.

Using this cellular pathway of gene suppression, gene function may be studied and high-throughput screening of sequences may be employed to discover sequences affecting gene expression. Additionally, genetically modified microbes and higher order organisms may be generated.

The following examples are offered by way of illustration and not by way of limitation.

EXAMPLE 1

Isolation and Characterization of DNA Sequences from *Lactobacillus rhamnosus* Strain HN001

*Lactobacillus rhamnosus* strain HN001 DNA libraries were constructed and screened as follows.

DNA was prepared in large scale by cultivating the bacteria in 2×100 ml cultures with 100 ml MRS broth (Difco Laboratories, Detroit Mich.) and 1 ml Lactobacillus glycerol stock as inoculum, placed into 500 ml culture flasks and incubated at 37° C. for approx. 16 hours with shaking (220 rpm).

The cultures were centrifuged at 3500 rpm for 10 min to pellet the cells. The supernatant was removed and the cell pellet resuspended in 40 ml fresh MRS broth and transferred to clean 500 ml culture flasks. Fresh MRS broth (60 ml) was added to bring the volume back to 100 ml and flasks were incubated for a further 2 hrs at 37° C. with shaking (220 rpm). The cells were pelleted by centrifugation (3500 rpm for 10 min) and supernatant removed. Cell pellets were washed twice in 20 ml buffer A (50 mM NaCl, 30 mM Tris pH 8.0, 0.5 mM EDTA).

Cells were resuspended in 2.5 ml buffer B (25% sucrose (w/v), 50 mM Tris pH 8.0, 1 mM EDTA, 20 mg/ml lysozyme, 20 pg/ml mutanolysin) and incubated at 37° C. for 45 min. Equal volumes of EDTA (0.25 M) was added to each tube and allowed to incubate at room temperature for 5 min. 20% SDS (1 ml) solution was added, mixed and incubated at 65° C. for 90 min. 50 µl Proteinase K (Gibco BRL, Gaithersburg, Md.) from a stock solution of 20 mg/ml was added and tubes incubated at 65° C. for 15 min.

DNA was extracted with equal volumes of phenol:chloroform:isoamylalcohol (25:24:1). Tubes were centrifuged at 3500 rpm for 40 min. The aqueous phase was removed to clean sterile Oak Ridge centrifuge tubes (30 ml). Crude DNA was precipitated with an equal volume of cold isopropanol and incubated at −20° C. overnight.

After resuspension in 500 µl TE buffer, DNase-free RNase was added to a final concentration of 100 µg/ml and incubated at 37° C. for 30 min. The incubation was extended for a further 30 min after adding 100 µl Proteinase K from a stock solution of 20 mg/ml. DNA was precipitated with ethanol after a phenol:chloroform:isoamylalcohol (25:24:1) and a chloroform:isoamylalcohol (24:1) extraction and dissolved in 250 µl TE buffer.

DNA was digested with Sau3AI at a concentration of 0.004 U/µg in a total volume of 1480 µl, with 996 µl DNA, 138.75 µl 10×REACT 4 buffer and 252.75 µl $H_2O$. Following incubation for 1 hour at 37 ° C., DNA was divided into two tubes. 31 µl 0.5 M EDTA was added to stop the digestion and 17 µl samples were taken for agarose gel analysis. Samples were put into 15 ml Falcon tubes and diluted to 3 ml for loading onto sucrose gradient tubes.

Sucrose gradient size fractionation was conducted as follows. 100 ml of 50% sucrose (w/v) was made in TEN buffer (1M NaCl, 20 mM Tris pH 8.0, 5 mM EDTA) and sterile filtered. Dilutions of 5, 10, 15, 20, 25, 30, 35 and 40% sucrose were prepared and overlaid carefully in Beckman Polyallomer tubes, and kept overnight at 4° C. TEN buffer (4 ml) was loaded onto the gradient, with 3 ml of DNA solution on top. The gradients were centrifuged at 26K for 18 hours at 4° C. in a Centricon T-2060 centrifuge using a Kontron TST 28–38 rotor. After deceleration without braking (approx. 1 hour), the gradients were removed and fractions collected using an auto Densi-Flow (Haake-Buchler Instruments). Agarose gel was used to analyse the fractions. The best two pairs of fractions were pooled and diluted to contain less than 10% sucrose. TEN buffer (4 ml) was added and DNA precipitated with 2 volumes of 100% ice cold ethanol and an overnight incubation at −20° C.

DNA pellets were resuspended in 300 µl TE buffer and re-precipitated for approx. 6 hours at −20° C. after adding 1/10 volume 3 M NaOAC pH 5.2 and 2 volumes of ethanol. DNA was pelleted at top speed in a microcentrifuge for 15 min, washed with 70% ethanol and pelleted again, dried and resuspended in 10 µl TE buffer.

DNA was ligated into dephosphorylated BamHI-digested pBluescript SK II+ and dephosphorylated BamHI-digested lambda ZAP Express using standard protocols. Packaging of the DNA was done using Gigapack III Gold packaging extract (Stratagene, La Jolla, Calif.) following the manufacturer's protocols. Packaged libraries were stored at 4° C.

Mass excision from the primary packaged phage library was done using XL1-Blue MRF'cells and ExAssist Helper Phage (Stratagene). The excised phagemids were diluted with NZY broth (Gibco BRL, Gaithersburg, Md.) and plated out onto LB-kanamycin agar plates containing 5-bromo-4-chloro-3-indolyl-β-D-galactoside (X-gal) and isopropylthio-beta-galactoside (IPTG). After incubation, single colonies were picked for PCR size determination before the most suitable libraries were selected for sequencing.

Of the colonies picked for DNA minipreps and subsequent sequencing, the large majority contained an insert suitable for sequencing. Positive colonies were cultured in LB broth with kanamycin or ampicillin depending on the vector used, and DNA was purified by means of rapid alkaline lysis minipreps (solutions: Qiagen, Venlo, The Netherlands; clearing plates, Millipore, Bedford, Mass.). Agarose gels at 1% were used to screen sequencing templates for chromosomal contamination and concentration. Dye terminator sequencing reactions were prepared using a Biomek 2000 robot (Beckman Coulter, Inc., Fullerton, Calif.) and Hydra 96 (Robbins Scientific, Sunnyvale, Calif.) for liquid handling. DNA amplification was done in a 9700 PCR machine (Perkin Elmer/Applied Biosystems, Foster City, Calif.) according to the manufacturer's protocol.

The sequence of the genomic DNA fragments were determined using a Perkin Elmer/Applied Biosystems Division Prism 377 sequencer. The DNA clones were sequenced from the 5' and/or 3' end, and are identified as SEQ ID NOS: 1–30, 32–213 and 399–410 disclosed herein.

This example not only shows how the sequences were obtained, but also that a bacterium (*E. coli*) can be stably transformed with any desired DNA fragment of the present invention for permanent marking for stable inheritance.

The determined DNA sequences were compared to and aligned with known sequences in the public databases. Specifically, the polynucleotides identified in SEQ ID NO: 1–213 and 399–410 were compared to polynucleotides in the EMBL database as of the end of July 2000, using BLASTN algorithm Version 2.0.11 [Jan. 20, 2000], set to the following running parameters: Unix running command blastall -p blastn -d embldb -e 10 -G 0 -E 0 -r 1 -v 30 -b 30 -i queryseq -o results. Multiple alignments of redundant sequences were used to build up reliable consensus sequences. Based on similarity to known sequences, the isolated polynucleotides of the present invention identified as SEQ ID NOS: 1–213 and 399–410 were putatively identified as encoding polypeptides having similarity to the polypeptides shown above in Table 1. The amino acid sequences encoded by the DNA sequences of SEQ ID NO: 1–213 and 399–410 are provided in SEQ ID NO: 214–398 and 411–422.

Several of the sequences provided in SEQ ID NO: 1–213 and 399–410 were found to be full-length and to contain open reading frames (ORFs). These full-length sequences, the location of ORFs (by nucleotide position) contained within these sequences, and the corresponding amino acid sequences are provided in Table 2 below.

TABLE 2

| Polynucleotide SEQ ID NO: | ORF | Polypeptide SEQ ID NO: |
| --- | --- | --- |
| 1 | 5511–4831 | 214 |
| 2 | 370–1482 | 215 |
| 3 | 2071–620 | 216 |
| 4 | 344–1159 | 217 |
| 4 | 1172–1933 | 218 |
| 5 | 13–912 | 219 |
| 6 | 513–1214 | 220 |
| 7 | 1352–546 | 222 |
| 8 | 597–1262 | 223 |
| 9 | 1189–452 | 224 |
| 10 | 1530–2303 | 225 |
| 11 | 314–1429 | 226 |
| 6 | 513–1214 | 221 |
| 12 | 2053–977 | 227 |
| 13 | 2367–343 | 228 |
| 14 | 125–2404 | 229 |
| 15 | 2481–3987 | 230 |
| 16 | 1336–419 | 231 |
| 17 | 1881–508 | 232 |
| 18 | 146–1166 | 233 |
| 19 | 5–268 | 234 |
| 20 | 6464–6162 | 235 |
| 20 | 6171–5296 | 236 |
| 20 | 5293–3764 | 237 |
| 21 | 1928–1017 | 238 |
| 22 | 1389–2575 | 239 |
| 23 | 1235–285 | 241 |
| 24 | 1938–3617 | 242 |
| 25 | 1965–2921 | 243 |
| 22 | 136–1358 | 240 |
| 26 | 1784–2915 | 244 |
| 27 | 3901–2960 | 245 |
| 28 | 1212–1988 | 246 |
| 29 | 11874–10894 | 247 |
| 30 | 5126–3690 | 248 |
| 399 | 1507–2499 | 411 |
| 400 | 2039–1638 | |
| 401 | 424–1740 | 412 |
| 402 | 3108–2176 | 413 |
| 403 | 1008–1568 | 414 |
| 404 | 4413–3886 | 415 |
| 405 | 6939–4990 | 416 |
| 406 | 64–966 | 417 |
| 51 | 877–1686 | 418 |
| 407 | 2514–1705 | 419 |
| 408 | 343–1155 | 420 |
| 409 | 1141–929 | 421 |
| 410 | 6281–5065 | 422 |

EXAMPLE 2

Isolation and Characterization of the Peptidase pepO from *L. rhamnosus*

The full-length gene sequence of a peptidase from *L. rhamnosus* strain HN001 (referred to as pepO: SEQ ID NO: 31) was isolated essentially as described in Example 1. Primers were designed to this sequence and employed to amplify pepO. from *L. rhamnosus* HN001 using standard PCR methodology. PepO was then cloned in the vector pTRKH2 (obtained from Dr Todd Klaenhammer, North Carolina State University, North Carolina, USA) and transformed into *E. coli*. Competent cells of *L. rhamnosus* HN001 were then transformed with the pTRKH2+pepO construct to overexpress the gene in strain HN001. The amino acid sequence of the expressed protein is provided in SEQ ID NO: 249.

Cell extracts of the HN001 strain constructs with enhanced levels of the peptidase enzyme showed enhanced enzyme activity on the casein peptide, $\alpha_{s1}$-casein(1–17). Specifically, $\alpha_{s1}$-casein(1–17) was incubated with non-transformed strain HN001 (referred to as DR20 WT) and strain HN001 transformed with the pepO construct described above (referred to as DR20 PepO:1 and DR20 PepO:4) HPLC separation of the resulting peptide products was performed using a Vydac reverse phase C18 column, 4.6 mm×250 mm. The solvent system was solvent A, 0.1% TFA in water, solvent B, 0.08% TFA in acetonitrile and the gradient employed was 15–40% solvent B over 20 minutes. A major peak was observed at 11 minutes, together with other non-identified minor peaks corresponding to hydrolysis products of the original substrate.

With non-transformed HN001 (DR 20 WT), the major peak of unhydrolysed $\alpha_{s1}$-casein(1–17) had a height of approximately 250 mAU. With each of the two transformed strains of HN001 (DR 20 PepO:1 and DR 20 PepO:4) the major peak of unhydrolysed $\alpha_{s1}$-casein(1–17) had a height of approximately 150 mAU, demonstrating that HN001 transformed with the pepO construct has enhanced peptidase activity compared to non-transformed HN001.

The pepO peptidase from strain HN001 was not active on bradykinin, a standard substrate for measuring pepO activity (Pritchard et al., *Microbiol.* 140:923–30,1994) and thus has a specificity that is significantly different to the homologous enzyme from Lactococcus.

This enzyme may be used to develop new characteristics in food products, supplements and additives, including cheese and hydrolyzed milk protein products. This enzymes may also be used to develop non-food products. The attributes that may be conferred by this enzyme include:

flavor and aroma enhancement;

removal of bitter peptides and undesirable flavors;

nutritional enhancement;

enhanced texture and functionality;

production of bioactive peptides; and removal of allergenic peptides or proteins.

These attributes may be produced in food, such as dairy, systems (including milk protein hydrolysates and cheese) by directed activity of the enzyme, either in a bacterial strain (including strain HN001, or starter cultures) or as an enzyme preparation.

SEQ ID NOS: 1–422 are set out in the attached Sequence Listing. The codes for nucleotide sequences used in the attached Sequence Listing, including the symbol "n," conform to WIPO Standard ST.25 (1998), Appendix 2, Table 1.

While in the foregoing specification this invention has been described in relation to certain preferred embodiments, and many details have been set forth for purposes of illustration, it will be apparent to those skilled in the art that the invention is susceptible to additional embodiments and that certain of the details described herein may be varied considerably without departing from the basic principles of the invention.

SEQUENCE LISTING (422 sequences)

SEQ ID NO: 1 - DNA, 5739 bp, Lactobacillus rhamnosus
caggccggttttttttaaaataaattttagttttaagttacacaatgattgattctagctcattcattagacttccgggcgcgccgcagatggcttactttcattaggaaaatgtcgtttgtaccactgcagcaaattacgctcattggtatttctcgccatccaaatcggcttcccgatccgcttcgcctcatccttagccgcaaacatttgactatggccaacaaaatcggtcgtcacaatcaccacatcagatttttgaacttttttcttcaacatcgcgccggaatccgagtgtgatgataacacgagtttgccaccgcgttcttcaacatggcgcttgactttacgcggcatggcggagttttcaaaacaaaccagcagcaaggttttatcggcaaagacttgctggacagctcgccgcctctttgcaggcttgaccgtcttgttcgctgtttgtgttgctttctgcttactagttgcagtgtttttatcagcgtctgtattcgccgactttgcatagcgttgtttcattcgggtcgcaaccgccgcggaatcagtgtaacgccaaatgatcttaccattgatttcctgaccgcgccgataagcgtagtcaatataatctcccggcttcaacttaaacaacatcacatcataatcgcctaaaagcaactgctgccgcgtctcgtgttccggtgattgaaactcaatataccaccgcttcacatcttcacgaaaaacagcaggcaaaaacttcaaccgtacaatttcggttggcaacggatcgcgcttcaacgttgtaatcttgtaattaacactatcgctatcctgatactcatcggcacgcacccagtccccattttccggtgggttcttcattttatgtaacttactttccgacactttaatggtgccgacatggccgccgttcaaatctaaatggaagcgaccaatgtacgacttatgattatttaaccagtgctctgataataatggtgtttccggttcaggattggattttggctgcgacggttttggctgttggggttgctgcggttgcgtctgctgctttggttcacttttagtttcaggcgctgtttgggtaatcatcggcgcaactgccgcattagattcaggttttgcaactgctgtattctcttgttgcggactcgtttcagaagtagtgtcaacaaaatcaatggctacaacgtcatttaaaagtttcagtaaatcttgaatgtcttgcgttattttctgaatattcttaggcgtcagttcagctgttttcgctgctacttgttgcttaagtaattcaataatctttaatttgtcattcattcaggcgcccgccttcatttaaggttgatttatctaattgtactgttttgagaagaatttaaaaagtgtttcgttctaaaataacgatcacttgtttcgttctaaaataacgagcactttagcagttcctttaaatctaaaaccggagctttacgctttctttacccgttgatcgccaataccagcggatatctcttcagtgtaatgaatatccttctttttagcatcatctaataacgcttgccacgccttccaaacattcgcttccgaatagcgatccgacaactcataggcttggtctgacatttgctgtaattcatccggatgggtgaatagttcaacaaacttagcggccatcgccttaatatcgccaaatggcacaacaaaaccatttttgccatcaacaactaattcattcgggccatagttgacatcataggtgaccccaaccatgccgttgctgagtgcttccatcaaagacagattaaagccttccatcacggatgcaagtgcataaacctgagcattccgttgaacggctccgacatcattggtgtaatcgtgcaacttgatcgcaccttgtaaatgatacttttcaattgctgcgttgatccgcttcatcgcccggttatcatcccggtggtcgacataaccatagacgtccaaagaaatgttagggacatctttcttagcaatcccaatcgctgcaacaatgtgatcaatttgtttttcaggggcaacccgcgccgtaaccagaacttttgccggctggcgatcggtcatggcaacatgcggtcgagccaactgttcatctggcaaaacgccaactggaatggtaaacaacttgcacgttgggtggaatcgctcgcgcacatcatgagtttgcttattggtagctgaaacaatcgcatcgtaatcattagcatgaatcaagctgtactcataaaaattattcatgaccgagtgcatcggatcttgggcatcgcctgcatgtgagttgtgtaaattcatgacaatataagcaggccgctgcaagtgaatgagttgccaatcgcccaaatgtgaccgatcaagaataaagacattgacttctttgtcattccagtattgctcattcacattattgtaaaaatgctgcgtcaaatcatctatattcgaaaacatataaaccgcaccgttgtcttcaatcaaccgccatccggtcttaatgaacgcatgattggcgtcatatttattaaaagtctcaataactggccgcccatcaactttatgccaaacctcagtccccaccttattatccggcgtataccactgcgacagcgacaaaaagccgcggaagtcataaaagtcaacccgatacaaatttccaaaaccatcgaattgttcaactgagctgacgcgttcagccgagtcatcctcaaagtaattgatccggccgacaaaaagtttgcctcgggtcaccaaatagcggtggttatctggctctttggcgtaactaagcttgtcgaatccaaaatcaatgtcttcagcgtgaagaattttagctggaacctgttcggcattctggtagtagtcaaacatgttcaaagcctcgtcatcactgaccccattatggtttaagtattcatgtaagcgaggattccattcgcgaaaaatcatcttgaaaggcacatgatgatcacgaaagagtcctgcccgcttcaattgagcgtgttcaatcccggaattatttttattaaaatttgaattaataaagaatatcatatgctaagctctcccctactttgagaatacgttaggaacagctgcttgttgagcctgccactgttgccaagctgccgcagcgttaaacttctgcgatgattcataggttgattcaagcatatcggcccacttatctttgtcggtcaacaacttaaccaacgccttggcaccttgttggctttcaccatttggcactaagtatccgctgatgccttctttaaccaccaacttcatgccatatttaacttgatagccgatcaccggcacgccaaaactcatcgcctgcaacacattcatgccgaacgcttctgaagaagaggtacttaatactgccgcggcgtctccaagcttttttgccaactggtcattgttttggtagccattaaagtgaacggcgtcttcaatttccagttttttaatcagttcttttagtgaattatcaagcgactgatcagatgagtaaccgtaaaactcaagatgtaagtctggtaagtcttttttcgcttttgcaaaaatcttaacggcttcttgtggttctttttccggtgaaattcggcccaaataaacaatcttattgcgatcacgtttttcagcagggaccagtttatgcggttcagcatatgaatccggcaccaccacgacatgcttaaagtggaagaacttatcgatttcttgcttttgctccacagttgggaccatgacgccatcaaagtcattcatgtgcgtggcaaatagtggttggagatagtcgacatagttacgcgatccacctgcttgttctggcttgtaagtatgggcactgtgaagaaactgccacttaccacgtgcgccaacaactgcggcaacttcactaatcaatgaaggccgatcattaattaagacgccagaatgtttaagcatcagttcattcatgaagaaaacaaacatttcattttcggtatcaaagcgccatgcccggccttgatagtcaagcagcttgtacatggtgttgcgcaattcgccattcacattcatccgcgtaatttcaatcttgggcttaccatcacgatcgtaaaaaacctgtgggccaaacgcaccatcaggatgaaaatactgggttgacgatttaaacccgcggcgatcccaaatgtctttagcgacaaccgtattcatatcattgtagtattcaatcgaccccacaagcccgactgtacctggcgcaatgttgactttaccgatcgttttaccatgataaacaattttagattcatttggatccacgccatcaatgtggtattgatacttagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcatgtcattaaagctagtctgacgctcttgagccgttgtttcttcacccgtgatcaggtgatttgagacggtgaggattgataacgcctgtgcatggaacttcgcagccagaagatatagtgcaggggtctccatttcggtggctaacacgccgtaatcgatgagcttttgacgatccatttcatcgttgtagaagcgatcttctccgagcacattacccacatggtagcgcaatgccccagcatctgccaaatttgctgcctcacgcaaaagctgaaagtcggctattggggcaaaatacatccccgccccaaacgtattcaaaacgatgctgctgtctgtcgatgatccttgtaccagaatgacatcccgtaccttaacatcgctacccatcccaccggcagtccccactcgaatcagtgttttgacgccataatcctgaataagttcattaacataaattgaaattgaaggaatccccatccccgtcgcttgaactgagatccgtcgcccttcaaaggtgcccgtataaccaaaggcattacgcactgtattgtagcggacagccttttccaaaaaatgttcggcaatatattgtgcgcgtaatggatcgcccggtaacaaaacaacatctgcaatggcgccttttggagcgtcaatatgtgtactcatgatgaaaattcccccttagttggattcgggtcgacaaatgaacgacaagcaagtgacaaccgtcagatggctacccgtcatcatccggattgattgcaactacaactaccggatcctagcctcattagcgaagcagactcaaaaacgattgacctacccgattcccggtgaccccgaaattgtcgagaatggtggcccctaagtcggaaaatggcgatcggataccca

SEQ ID NO: 2 - DNA, 6365 bp, Lactobacillus rhamnosus
ctcatcggatgccggaccagctggcggcatttggcaaacatgctgctgatcaaggttttggcgtgattattgcgggtgcaggtggtgctgcccatttaccgggaatgttagcggctaacacgctgctaccggtcattggtgttccaatcaaaacacgaacattaaatggcgttgacagcttgttgtcgattgtgcaaatgccaggaggtgtgccagttggaacgatggcaataggtgatgccggcgctgtgaacgctgctttgtacgcggcatcaatcctcgctttgcaaagtcctgaattaagtcagcggctggcggccttccgtcaagcccaaacgcaacgggctgaagaaagtgaggccacacttaatgattgatgtggttacctcacctgccacgattgggattattggtggcggtcagcttggacgtatgttaacccaaagtgccaagacaatgggctatcgagttggcattttggaaccgacgccgaattcaccagccggtcaggtagcagactttcaaatcacggcaccatacgacgatcaagcggcactgacaaagttggctaaagaatcggacgttttaacctatgagtttgaaaatgttgatttagcagctttggaagcagtacgtgatttaacccgaatccctcaaggaacagctattcttgccacaacccgcgatcgcatcaaggaaaaaacattcctgcaaacgcatggcgtaccggtcaccccctttgcggcagttgatcggcctgaggcgttgacagcagccattgagaaaatcggcttgcccagcatcttaaaaaccacgactggcggttatgacggtcatggccagcaagatatcaacaccatggctgatgtaccggcagccgagcagttgctagcccacggcccctgcattttggaaaaacgccaacagtttgaccgggaagcttcagtgatgatcacccgcgatggccgcgatcaagtacgggtattcccgattgttgaaaatcgccacaagaaccacgtcttgcatctcacactggcaccggcaccgaatatttcaccggttttggctgaaaaaattgatgatctggcgactaaaatcacacttggactcgatttacgcggagttcttggggtcgaactctttctcgaaggtgacaatgtcgttgccaatgaattggcaccacgcccacataactccggccactattcgattgaagcttgcaacttttcccagtttgacgctcacattttaagtatctgcggacttccgattccgcagattaccttaaaacagccagcggtgatgcgaaacctgcttggcgatgatctcacccaagccaaggcaaaatggccgcaacatccagaatggcacatgcacgattatggaaaagccgagatccgtcctggccgtaaaatgggccacatcacggtgaccgatgcgcgcgatgttatggacatacttaaacaaatggaggcagcatggtgaaaaagaccacattactatataccggcaaggccaagcaggtttttgcaacagatgatctaccggttcggcgatgataaggagatggccaagtcaattgcgttgtcagtgccaggcaagaccccgaaaatggctaaagcctacacgactgctttaacctggtcattggaatcaacaccagcgaataccacaagtaccccaagcactacaagcacgccaagtacaacgggtaccaccaaaccttaaaaagctggaacgacactgatgatttttggctagcatcaacggtttgctaacggacttgaaacattcaaactcattggagaaggatacgatgacggcactaggccgcatcgttgggggaacttaatcaaaaggagatactttgtgaagaaaaaacttttctgcttcataacgcttattgtgatgttgatcatgcctgccactcaagtttttgcttcggaattaaactttgctgctaaagccgagttaccggacaatcaagtgaatcctgatgttagctattttgacatcaaaatgaatcctggcgcgcagcaaacgttacatgttcagttgcgtaatgaaaccgaaaagccagtgacactcgatgtcgagcttgccagtgccaccacgaatctcaatggcgtggtggaatatacacccaacacgattaagccggcaaagagtttgcaattcaacatgaaggattatgttaaagcgcccaagcaaaccgttattccagctaagggcagtaccgttttggatttagctgttaagatgccggataaaagttttaatggcgtcatggctgggggaattacccttaaagaacatggcttgagtgatcaaggtggccaagcatcaggcaaaaaggttgcgatcaaaaatcgcttttcctatgtcatcgggctcctgatgcgccaaaacttagccgctgttccagctcacgttaaattgaatgcggttaagccaagtcaggttaatgcacgcaatgtcattttaacttcgatggaaaatgatacggcaaccttcattcagcaagtagccgtggatgcaaagatctttgctaaaggttctaaccaggcactttaccaagttgccaaagaagggctgcagattgcgccagatacgaactttgattttccaattgcgttggcggggaaagcattaaagccgggaacgtatgtggctaaactcgaagtctatggtaatcggcagccaaacggaaagatcttacgcacaacggcagaaggtaagcagcattaccgggatcactggaccatgaccaaacaatttaccattaccgaaaaagcggcttcaacgttaaatcagcgggatgtgacgatcaagccaagccatccgcagtggacgtacattctgattggtgctgtgatcgtcctcatggcactgatcatcctgctactgattttgctactgcggcgtcaggctaagaaacaagcttcttaatcaaaattgtctgagcaaggtgtttgcaagttttgaaaactggcggcatcatggacacaaataaaggactctgagaattcgtgaacgataccgatccagaagaaatgatgatatctgaaaattcgcgcctttggttatcagcaatgtttgctgctgatggcaaaagtgggcggatttttgccgtgagttcccaaagccgggtgagttatcgttggcggcgtttgaacttagccaatttagcgtatcggcttgccggaaaaacattgttggctcaatcgaggatagaacgtgctaaaaagtaaggtggatcttgtgaaattagttgaactgatggaaaaaaacgaccaaaagaagcttcagttactcaattatcttgatcaatatccgaatcgtcaggtaagaaacagcgagttacaggataaactacaaatttcctactatatgtttaagcgatggacaaaagaaattgtggacgatattgctacttttcaactggatgatcgttttagtcttgaagtgacggatgcatcaacgatcttgcatgagcaccataataccaatacttcggtctttttggcgcactatctgaaactgtcaccaaaagtcaatatcctgctgacgctgatgacccaacaagccacgtttaacttagcggactttgccgaggcgaactatgtgagttacacgtttatgtataaacgctatattgcgctgcgggagacattgaaaaagtggcagattactttgacgagccaaggcgagctgacgggcaatgaactcgcgatccggctgctattggccaaaatcatggtggtcacacatgtcactgaagataagtttaatcatgaggttcggctggccttagccgaattgctgggcctcatgaaaacaaccgatgccaagccgtcaatgagccaactgattgaaaccaaggcttatgtgctaattagtttgctccgctgtcaacagggctatacaattgcgagttcccaagaagtggctgatttggtggccaatattcgtcaaggtaccttggcaaccagaaacaaagcgattgcgatctatcaggctcattttgacgccagcgatcaggcaattaacagcgaatgtgactatttagggacatttttggcgattcttggcattattaattccgaggaaatcgtttttccggagacaattaagcagcgcgggcaagcttttatccacggatttgaagtcaagtttaaagtgacattatccgccgttgctaagctgaagattgcgtatgcagtcaataaatgttttgtagatgttttggtattaccgtttcgcagcgagtttttcgatgatcatatcgacattagctacttctttaaaacttacccgggattttttgagtattgtcagcattttgttttaaaccaggccttgcacttgacaagctcacaggcacagtttttgttttaccattgtttgttggcactcgccgccaatgttccgttgagcaaggtattagcaccattatcgatttgcgttgactttacatccggtcacgactacaacgctattattacgcgggatattcagtcattttcaactttgaacattcagatgacccagcaagttgaaccggaaacacaactgattattaccgacttggtgaatgcttatcatgattacgatattccaaaagtgatatggctttctccgccgcggcctgaggattgggaaaatttaattaatgaattactgcgattacgcgagcaggcacaagaagaattccaaaaacgctagaaatttttcgttgcttttttgcaacgaagaattagttgtgaaaatagtgtaaatggactagccacactggattaagcgcctttggataacaacggttattcaaaggcgcttctttttatttaactcaaaacattttgatattaataaatgtaatggtatactcgccctattcaaaaacggaggcgagacaccatggaaaaggaaacaggtttttggccggcgattaaagactttttctttcgtgccggtgattttaaaggcgttagttcacgctcacagtattggtgggtatttctaggacaattcttgttaggcattgtcattggcttggtatctgtgtcgttaggtgcgacattctcggcgaaaacgcaatcttttggcagcagcatgataagatcactcttgacaacattagtcgcggtccctatgtatctaagctacccgcaactgagtctaacgcttcggcggttccgagatgctaaggttaacccatggtggtaccttgtgctggtaatcgttgcattggtcggaccattgctgacggccaacggtatgggcttgttgccaatgatcatcttgccgcttattgttgcactggtaacactcattatccttctattacctagtcgtgaacagaccgtgaagccttttccagctcacccgcatacaggtagtaccactggtgtaggttttggagcggcagtcaaagatctattccttcgtggtggcgactttaccgggacatcgagtcgtagtcagtactggtggagtatcctattttcagcgttgatctttgtgccaacgttcttctttctcgtcttttcgatcactgcagcgctccttggcagcgctgcattaggcaaaatgcaaccgcagaatatcattaatatgattaattcattgggtattggtgccgtgattttggtggcgattatctttgctgttctctatggttggtcgatggtagctttgccaatgttaacggtcacttggcggcgtttcaaggatgcaggtgtcagtccatggtggttcatagctcttaacattgcgtcaagtatcgtctcggcagtacaaggaagtgtcccaaatgtcccattaaacctggtaacactcattcttcttattgcgcaaatcgtcatccttgctttaccacctaaagttcaaaatgacgaagcataaagtaatctgtaccacgcaaaaagtgcaaccttccgcagcggaggattgcactttttaatttgcgcttttagttgcagggtgaatcaataaatacctttttcgtcttcatcaaccagtggatcattaaagtttttgtggaagtacgtgctgtcgatgactttaaacttgccattcgcaaagcgggcaatgatttcgccgtattgaacgatgagtggttcggtattgggaatttcgattttcaggcggccaataggcgttttggtaaggtattgaaaattgtcgccgaagaagccttttaggtcttttgtattggtgtcgtgtgaatacggtaagaaatgggtcattttggccgttgaaaatgccgcaaattcgccttttgggaatccttccaaagatgaaggttgagccatggtattctcctcctaagctaagcgtgagccggtgggcgcgttcatgtgtgg

SEQ ID NO: 3 - DNA, 7754 bp, Lactobacillus rhamnosus
attgcaggccgatatgggaataaacacacgatgcgtctgggtatgatcattggcttaatcggccagctggtcatggcaggtggcgtttatgcgcggaacttgtggattttatttcctggcattttgattaacagcgtcggccaagggatgattgtcggtttagtgtcgattatgttagccgataccattcgctatggcgtcaccctcggcgctcaggcggaaggcttatttgcctccagcaacgatttcggcgttaatctgggactcggcatcggcggcctcatcactgccggactcttcgacctcaccggatacgtgcccaacaccagtcaaaatgctgcaacgcttggcatgattaacctgaattatgtctggctgccgttggtgctgtatgggtttgttgctgcttttgattcacttttatccggaaaagcaaatgttagctgcgattgaaaaggcatcaggcttaagtcgcccagcaatgatatgggctgatgtttttgcccgctcacatgccaatacgtttttcccgcatcggctcgcgcgccatacgcgttcaccggtacaaaaaaagattcaacgacttccctaaaggcagttgttgaatctttttttctcactgagcatccagatcattttcatgaagccgagcaataacgggcaaaatcagccctaatgccaacaaaataaccggcgtaataatattcaagcccatctggaaccaccatgtgccggggtcattaagataactgattttcggtaacattcccaacaagcaggcaaaggcggtgaagaagaagcaccaacggcccacgagcatgcccaagcgtttatttttaaccagcatatagtcggcctggaacttttcgagatgttgatttagcaaataatacgcgaggaaaacccacagatagcgcaacggcatgaccacagagttcaaattaagcagccacttgtaaagctcgttcatgttgccaatgccaaacgctggaataatgatcagcagacttaccagaataccggtcatccagtaaccattaatcggtgtgcctttgcgattgatccgccgcaattttttaggaataaaatgcggatcggcgtcactcagcaagattttcagcggcgcatcaatggaaaatgccaacgcggagattgaggccaaagcattagcgattgaatacaaaatgacaaacaaaccgccgacgtgataatacttgcctaacattgcaaacgctgtgtatgggccattcgccataagatctgtcggaatgtggtggctgttaaacaacatccccataccaaaagaccctagcaacgcgcaaaaggcaaccatgcccgccagcaccagcatgcccagcggaaattccttggaagcgtgcttggtattgttgacgtatggcgatatcttttccgcgccgccaactgcaaagactagcatggagatcgtcgtgaagtagttgaggtcaaatttaggcaagtaagtatgaatgtcgcccatattcggagtcgccacatggacgccttttaccatcaacggtgcggtcacagctagaataatgaaaagaatcgacatcagaaacatcgccgtgcctgccatactgccaatacgattcaaggtggttagcccgcgcgaagacagccaaaggaaaagtaagaataacgccagacagattaaggaaacggtcatggacgagacggtgttgacaaaatcaccgttgcctttaaacagccagctcaaggcaatcaaaatcgcttgcggcttctgggctaaataagggatgtgcacgacccaataagtccacgccgcatagtacgccaatcgcacactgccggtttccttgatccaggaactaacgccaccggcttgatctttaaacgttgatcctagctgccccacaatcaaagcatagggcacaaaataaatcagcataatcagaatccagctagtgacaacggaaaggccttgttgtgcatagttattgaacacattgccaagaccccaaaccgatacgaacgcgattaaggccacgttataccagcgcagttgtttctttgtgtctgccacaaacatccctccaaacggtatcctgctcgattaggaacagttactcgctcttcagtgtaacggtttgaccacctctctttcccgtgaaattgtatagataaggattagatttttctaaaagcccggttgcggtttcgttatttcatgccgtatggatactcattaactggaagtatgaaggtataaaaagaccaccactgtaatgctgagtggcggccttttgtcatttctctttagctatcagccaagacggctaatattttacttaatagctttggcaactgcttcatacacagcttgttgctctgcttgaatcagatcgacgcgactggcgataacgctggtgtccatggtgatttcccgcgttaggccaggtgtcggtagttttggctcgaagaatttcttgaattcatcgagtcgttgcgtggtgcggaaaataccggcgataacggtgatgtaggtggtgaattccatgtcgccgccaaccgttttttcaagccaagcccattcgttgcgaacccaatcccatgctgcttgttcgccggcgtggttgctcaagacgccgcggaaccatgagcgcaaatcttgcggcttaatggtgtcggcattttcaaattgatccacaattttagcgattaacgcggcatccggggtgctggttaacgctgcaagaatatcggctttgtagcttgagtcggttgtctgcttatacgccgttaacaactgatcgaacaaggtggcactgccgaagtttttcacttcattttgaaggacaaacatccgcacatcggccggtaattgaagcaggtgatccttatttgccgtaaatagatcgtgaccttgcgcaatggcgtctttattcttagcatacaacgccatgcttaggatataaggacgggttaattgatcatcattggattcgccgacttttggtgtccagcccaggcgcttgaactggtcggcgctgagttggttgaagaaggttttcagctgcgtttcttcggctgaatccgggttgacgaattgttttaagtcattggccacccgatacaaggcgttgatgacgatggcactgtgactctgggcaaaccgcggcagcaacgacacaatgtcggcataagcattttgccgaccctcagccaataaccgtagatcttgaagtacctgccgctgatcaatcgcattgagttggtcaagatgcgccaaaatatcggcgagtaaggtggcgtcgtatttcacgatgaaatgcgagttattgcccacatttacacggaatggttgaccgcttgcttcgcgcaactgggtgtaatcgcccaaggttacctgcttatccgcaaaaatctgcggtgcggcagcataattgctattgagcggaatctgccattgcctgcctgcatctttgcctgcaccaatgaagaattgttgctgggacaaggtcagtttgccatcaaccaccgctgctgtcaccactgggtagcctggttgttccagccatgactgcatgatggtgccgacatctaacttagccgctttacccaaagctgcccacaaatcagcaccggcagcattgccaaaatgatgggcctcaaagtatgccttcaaaccggcccgcaacgcatcatcaccgattaaggaacgtaccatgaccagcatccgcgcaccttttgcatacacaatcgcgctgtcaaaaagcgaatcgatttcagccggatcttctacttgaacatgaactgactgaaccccatccgttgcatcacgttgcaacgccattggtacttccagtgtctggaatgtttcccaaatatgccagtccggttgcaaggcatcaaccgcaacatattccatcatgttggcgaaactttcattcaaccacagatcgtcccaccacttcatcgtcaccaaatcaccaaaccattgatgcgccagttcatgcgcaataacggtagcaacccgctgcttggtttccagcgaggtattgtccggatccagcgtcagcaacgcttcccgataagtgacaagcccccagttttccatcgcgccagccgaaaagtccggcaacgccaactgccaggaatgcggaagtggataaggggtctggtaaaagtcttcgtaaaattcaatcgagcgcttggcaatgtctaacgcgaagtcaagctcattaggttgatgtgctttggtagcaaaaaccccgattttaacgccgctcttggtggttgtctgcttattttgcaattcaccaaatgcaaaggcgatcaggtaagtcgacatccgaaccgtggtgtcaaaataatgaacgccattttcttcacgaacttccggcatgttactgataatcgtttcaccgggatgttcatcaaatttaattgctaaatcaaacgtcgccttggcttcaggctcgtctacactaggaaacgcctgacgtgcagccgttgtttcaaactgggtcccgataatctgcttcttaaccccgtccacttcgtaataagaaggataaatacccatcatggtgtccgtcaacggtgcagtatacgtcagtgtcaacgtcaccttgccagcttgcggcaaagtaatccgcaccgcttcggcaggatcatccaccgtaaacggaacatccttgccgtcagcctgaaccgcactgaccgtcaaatacttctgatgaaccgcaatttcggtttgcttggcatcaccggtaatcgtcgtcttcccggaaatcttcttcgtctcccggttaatatccaagtaaagatcgtaatgtttcggttgaaacaactgataaaaatgcgtggctacaagcatgcaccaattcctcttgtgtgtgagcgcaacccaccgcggaagaagtcggagtgtaagccgccttgggcgtgatagccgccctttggccattgggacccaggtccttacacccaaacttttgcgctggtgagcgcgttatgaacaaacgccgacccaacgccggtgaaaaacccgaccccgtgatgaataaaccccccacccaaacgggttaaacccttacaccggcaaacccgtgatgaaaaccttaaataccgcttattttaccccaagtgggccccccgtttgtacaaaaaatcacaccgtctaaaccgcttggttgcaagaactattttaaacgggttaccaatcgccgccgcgccaaaagaaagtttatgatcatcaaaacccccgcgacccctagtggaacccaattatcgtttacgggtcgctacgccattaaggtcaacaagtttaccagcccataattgattgctaccaatacaaagcgcaaagtagacggtcggaattaaatacgccaccgcaagtgactgagagcaacagtaactaccaagcgtgatgctcccaataaataaactcttaaccagcgcattgcccaacagaacgccagcagccaatgtcgttccctgaatctgatatagaccaagcagcgtaacgttcagcactgccaacacgccaaaataccaagcaaatcgcaccgcgtaaaccgtccacaattggatcgatttactattgataactgccgctacccctgttgtttgctccggtaaaaataagctgccaaaacaaaagatcgctagcaacggcatccacaactcagtcggcatcgctgcttgtgccaagctctgcggtgtcagcgtaaaaacaatcggaatgagcccccagccaagtaccgcaatgaggctggttctcaagacgttggttttaatttctaatcggacgaagcgacctaaacttgagtgcatgtagttagctccccgttgtgcagccaagatccaagcagttaacgccatcagtccaagcgccaacaaagcgtatccgagccgattttgcaacagctggtttaaatgggcatagtaatacgcgccattgtgcagcgaattatgccgcgggatcaataaccatccgtagttaccactcactcggcgagcacccgccatcatcgttaccaaccaccagccaatttgaatgccaaaaccaataaaattaccaaagatcgccgcacttaaatagccaaccgcactgctgaccatgagcgttggtaacacccagataaaagccattttcacaatcgcggtataatccaacgacatcccttggtataaaacggcgacctgaatcgtcaacgcaatggcgatcacaatcactggcacaaataaacttcctaaactcgcgacataccgcgtcaataataagcgcggcgtggtcatcgccttggtttgaatcaccgccgacgcatgatgccggcgatcggcagtacaaaaagcaatggccacaattgtcggtaaaatgcccatcatgattccggcaatatccgcaaacaatctcgcaaacgctccggtgacccgatcacgttgccgaatgagctgctgatccgcgacgacttcggctttcgtcatccggcgataagcaaaattctgaatattttgtgaactgtacgcagactgtccacccaagagccggtcaacttttgccaacgttttaaccaagggtgcgcgcgtgtctgcatcctccgcctcagtcatcaactgccgaacttttgcctggtctgccgcgcgtaacgtcacttgttttgcaaaccccaacggataagtcgtatacaaattatgccgataatcgtagtgcaactgatccagactgtttgtcttgagtgtctgataatcggtcgctgtaatattttcgtagctcgctggtgatttcggcagggtggttaagtttcgtgaaagtaatggccagacattcatcacgataaatgccacgactaaaaatgtgtaaataacaaacgttaaacttcgcgtctgccgcttaaattccatccaaagtagcttcacaatgacacctcctcacacactgcttaccgtcttcaccaacgcttgatgatgctgagtttgtgaatacagatacgcctcctccaacgttggcgcaaccgattgccaagttgccaacggagtacgagctaacaagcgtacccgaatatgctgcccgtgcgctgtttgttcactaatctggtactgcgtcttaaactgtttaagctgcgccaccggtaagtcaccgacaaaaacatgccccgcagccgcatcaataagctcgtcagtggtcccattgaaaaccagtcgcccatgatcaaggatgccaatacgattagtcgttgcctcaacatcggaaacaatatgggtagacaagagtaccaaacgctcattagcaaaatctgccaacaaattccgaaatcgtatccgttcttccgggtccagtcccgcggtgggttcatcaacaatcaaaacccgtggctcattcacgagcgcctgcgcaatgcctaaccgttgcaacatgccgccagacaacgccttgactttcgttttcgcctgagctgtcaaatgaacagctgccagtaaccactcaattcgccgcttctgctcgcgagccggcacctcagctaagattgccaaataggtcattgcgtcaataactttcatggttggataaaacccgaactgttgcggcagatacccaattttgcgccgaatactgcgcgcatctttaagtggtgtgccatccaccaacaccttaccggaagtaggtttctcaagtgttgtcaaaatcttcatcaacgtggatttaccggcaccgtttttccccaataatccatacattcctgactggatattcaacgaaacgt

SEQ ID NO: 4 - DNA, 2483 bp, Lactobacillus rhamnosus
agggtgtggattccacccaactgggaatcgcggcgtaatatgtgcgaagtcccccttaaacccattttcggaccgggccgcaaaccgttggccggtggctatttttgggaaaaattcaacttctgaaaggcattccacgcctaattccgtttgttgttttcttccggaaggttagtacccgtacttgttattcgcccgtgttgtttttcaacggtgggcgccccgctaatataggcaatcgcactatttaaaaagatgccggcggcttaaacggggttaggctttttagtatcaattaggctttacccggtatgataatcccgataatacgtggagtcagaggatgcaagaactggaaaagtattcattagatgacacttatattcgaccatttgatcgcgaaaagcaggaaattgcgcttgaaacgaaagatctgcatgtcttttatggtgataatgaagccattcatggcgtttcgctgccgtttgaacgctataaaatcactgcattgatcggttcaagcggctccgggaagtcgacatacttgcgctcactcaatcgaatgaacgataatattgaaagtgcgcgagtcaccggtaaaatcatgtaccggaatattgacatcaatagtgatgcggtcgatgtttatgagatgcgcaaacacattggaatggtatttcaacggcctaatccatttgccaagtcgatttacgacaatattgcttttgcactgcgtcggtttggtatcaaggaaaaaaagaaactggacgaaattgttgaaaccagtttgaaacaggctgccttgtgggatcaagttaaagacgatcttaatcaaagcggtatgtcgctttccggtggccaggcacaacggttgtgcattgcgcgggcgattgccatgaaaccggatattttactcttggatgagccggccagtgccttggatccgatttcgacatcggcagttgaagataccttgttgtcattaaaagataagtatacgattatcatcgtgacgcataacatgcaacaggcagcccgaattagtgactacacggcgttcttttatagcggagcagcgcttgagtatgatgaaacccgtaaaatcttcacgcgtcccaagattaaagcaaccaacgattatgtttccggacatttcggctaggaggttcccatggctgaagcacaaaaaatcattacaagttcagatgttcatcttttttatggtaagtttgaagcgctaaaagggattaatctggattttaacgaacatgagatcacagctttaatcggaccttctggctgtggtaagtctacgtatttacgaacgttgaatcggatgaatgatctgattccgggggtgacgattacaggaaccatcagtttacgcggtcagaatatctatgcgcctagtgaagacgtggttcaattacgtaagcaagtgggcatggtcttccaacaacccaatccgtttcctttctccatttacgaaaatgtgatttatggattgcgtttggcaggggttaaagataaaagcattttggatgaagcggtggaaaccagtctcaagcaggcagccatctgggatgaagtgaaggatcatctgcatgacagtgcattatcgctttcaggtggccaacagcagcgggtttgcatcgcgcgggtattggcagtcaaacctgatgttgttttgctagacgagccgacgagtgccttggatccgatttccagcacgcaaatcgaaaacatgttactcgagttgcgtgaccaatacacgatcattctagtgacgcatagtatgcatcaagcatctcgaatttccgataaaaccgcctttttcctgacaggcaacctgatcgaattcgctgacacgaaacaaatgtttttaaatccaaaagaaaaggaaaccgaagactatatcactggacgcttcggctaggaggggtagtatgcgacgactttttgttgacgaattgaacgatcttcatgtacgtttttcggaaatgggaatgatggttaatgaggccatctataagtccgtgaaagccttcatcaatcatgacaaggctttagcccgcgaagtgatccacgaagacaaacacattaacgagcgtgaagttgatttggaaaaacgcagcttcgaattgattgccttgcagcagccggtgacgaccgatcttcgggtgattgtcacggtgatgaaggcaagttccgatctggagcggatgggggatcatgccgtttcaattgctaagtctactattcgagttaaaggtgaaacccgggtaccgcaaatcgaagctgatattgccgggatggcagacgcggtaaaagagatggttgaacaggtgctggatgcctatgtgaaggaagattcagcccgtgcacgtaaaattgccttggaagatcacggtatcaatgacttttcatcgcggatttacaaagagtgtatccgccagatgcaggaaaaccccgaaaccgttgtc

SEQ ID NO: 5 - DNA, 1720 bp, Lactobacillus rhamnosus
attcgagaagcgatgctaaaaaaatcgcgctcatcaaagttagagcggcgcggcaaaacgattagcctgatttgtatcagtctgattgtacttgtagtggtggcaatatttttctttgtcgcctcaaaaggattagcaacattctttcaaaataagattaatttatggtcgtttttgagtaagagtgtgtggaacccatcaattaaagatgcccatggaaatccggaagttggcgctttaccgatgattgtcgggtctttcggcgtgacttttttatcggcaatcgttgcaacgccatttgcagttggcgccggcattttcatgaccgagatttcccacaagtgggggcaaaaagtgctacagccggttattgagctgctcgtcgggattccatctgtggtttatggcttcatcggcttgtccgtcattgtacctttcattcgccatatctttggcggtactggctttgggatcttagccgggacttttgttttgtttgtcatgatcctgccgactgtaacatccatgaccgtcgatgcgttaaaagctgtcccgcgccattatcgcgaggcttcattggcgctaggtgctactcggtggcagacgacttatcgcgtggtgctgcgtgcggcaattcccggcattttgaccggtattgtttttgggatggcgcgcgcttttggtgaagcgttggcggttcaaatggtcattgggaatgcggccttgttgccaaagaaccttgtttcgccagcttcgacgttgacttctgttttgacgagcgggattggtaatacagtcatgggctcgctggaaaataacgctttatggtccttggcattgctactgttgctgatgtcattagcctttaacctgttgattcgttggatcgggaagaaaggggagctgaacaaatgaatccaaaagttgtcgataaaattgccacaacggttctgtacattgtttcagggattatcattgttattttggccagtctcctcgggtacattctttttaaaggggtaccgcatatttcctggcattttctcacgagtccagcacaaagctttgaagctggaggcggcattggcattcaattgttcaactcgttttatcttttagtccttgcgatgctgatttcaacaccgatttcgttaggggcaggcatttacctcagcgagtatgccaaaaagaattggttgacggatgttattcggacttcgattgaaattttaagttccttaccgtctgtggttgttggactgttcggttttctgattttcgttttacaattcaaattcgggttctcgattttatccggggccttagcattgaccgtcttcaacctcccgttgctgacgcgaaatgttgaagattcattacgcggcgttggctttgaacagcgtgaggccggcttagcgcttggcctatcgcgctgggagacggttttacatgttgtcatccctgaggcattgccggggattattaccgggatgattctaggtgccggacgggtttttggcgaggcggcggcgctaatttacactgctggtcaaagtgccccggcgctggatttcaccaactggaatccggctaatattgcgagtcccctaaacccatttcgaccggccgaaacgttggcggtgcatatttggaaaatcaactctgaaggcattcaacctgatgccgttgctgtttctgccggagctagtgccgtacttgt

SEQ ID NO: 6 - DNA, 1717 bp, Lactobacillus rhamnosus
ttttcaaaaatggtcgtgccactgtatcgctcggctacatcggtctatatgaagtcggaacggtcttttatggttcagcatgggagaagaatcatgacgccaaggccttttccgtttcgattgtgaaggcgctggacgatccttaccatgcctgcgatgacaattgccttagtacctgtgttggtgagtttgatactcggtgccggcttaatttggcaagcacatcaagtacatttaaacgtgacacaaaccaatcacggggtagttgtcatcggggttgtcccacagacaccagccgcacaaatggatttgcagccgggtgatcgggtcttgacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagacaaagtacgtagcgagccgtttgactttattattctcgatctcatgttgccgagtttgagtggactggatgtcacctgtaagattcgtgaagaaaagattcaaacgccaatcatgattctgacggccaaagacaacgaaaccgataagatcgtcggacttgaacttggtgcggatgattatgtgaccaaaccgttttcgccgcgggaaattattgcccgaattaaagccatcgaacggcgtagtcaaagtcaaccacaagcgccactttcccgtaatgccaatcaaattacggtcggtcaaattacgattgatcctgaaaattataaagctagcaaagccggacaccgactccaattgacccctaaggaatttgaactattggtttattttgctcaacgagttggcaaaacgctatcacgcgatgctttgctcaatggggtttggggcttcgattacccggcggaaacacggatggtcgatattcaggtcagtcatttgcgggataaaatcgaaacagatcctaaacatccggattacttaaagacggtgcggggattcggttatcaaatggaggcgccacatgaataaacggattttacgccgtgtactggttattagtctgctctcgttagcaggcttttttgtactcgtcacgacggtcaatcaacaaatcgtacatcagcaggcacgcgatttgaggcgcgtagccagaacctatgcagcctctgctaaggatggcgttgatccgcaagcgctgggcaaagtccgaagccgcttttattacggttgttccggataatcccaaaaccacccgacaaaaagtgatggccgatgccttacgtggcaatcatcgcgaaccatttgtgacaacggttaatgttcttgggcgagctgaacaggcatatctgtttcgtcaccggggacactgggttgccgttagtcgctataagtccagcgtttggacaacggcgcctgagcaattttggattttgacgctgacatttgcggtcctgattgctttaattctggcttggctttttcgctcggagcatcagtatcaagaagccattcgggtcatgagccacaac

SEQ ID NO: 7 - DNA, 1494 bp, Lactobacillus rhamnosus
tcaatcaagcctaagtagccaatgatcgaggtcaacggtgtgcggatatcatgactgacattggtaatcagctcatctttactctgttcgattcgtcgctcctcttccatagagttcacggtagaatcaaccagcgcattaatgctgctaaccactttttgcagctcggtattcacctcaaatttaattcggtgatccaagtggccatccgcaatataatgcaactctgcaatcacgtggcgcatctgcatctgccgatatcgccgtgccaatcgccagtacaccacaatgacgtctgcaatgcccatcaaggtaaggaaaagattcgaccagctccacagatgaaaaccgccgcggccaaaagtcaaattcgtcttcacaccccagattgcattctccaacccgggattatgcgcaatcatctgattaatcagcactaacagcgcaaagttcagcatcagtaacaaaataactgtcacaatgccttcaatccacaactcggacttttccttaccagtgagtttgaccttttcgctcatgaactaggcctcgaccttgtagccaacgccccagactgtttcgatgaccttctcaccatctgttgcctcttcaatcttgtcacgcaggtgtgaaacatgcaccatcacggtcttggcggatacaattgactcctgttgccaaacccgctcaaaaatctcatcagcggaaaagacgcgattcgggtgactggcaagcaagtagagaatcccaaactccaaagccgttaactgaatctgtttgccggtcaaagttgtgacctcgtggctatcctttttaatcgtcaaaggcccgacttccagcacatccggctccgaattggtcacctcattttgactccgacgcaaaagactcttgactcgcgccatcacctcaagtggattaaatggcttcgtaacgtaatcgtcggcgcccgtgatcagcccttgaatcttatccatatctgctgttttagctgacacaatgataatcggaatttgcgaatccttacgcacttccttaaccacatccatgcctgacatattcggcatcataatatccaaaatcattaacgcaatatcgggattggtcacgagcttggtaatcgcttctttgcccgagtatgcttgaattggttcatagccttcgtttttaacataaatgctcaatagttcaacgatttctttatcatcgtctacaattaatatcttcataattttgactccatttacacggcaatcgttagggactgtaacatcactgtccattgtaccaaaattgaaccgggaattctttacgaaaaccctaagaaaacgagtgccatacgtgctttgcatttcaagtgggaggtgttcttttgccaaaattaacaaccctcgtagctgccagtttgccgcaaacgatgcaaattgccggtattaacattgcccattcaagcggtagtacctattggctgcttcaccaccaagacgaatggct

SEQ ID NO: 8 - DNA, 3356 bp, Lactobacillus rhamnosus
atggccggcaatcctaaccttccccgtacttggcgtttcaatagttgccaaaatgttcaaaagggttgatttgcccgcaccactaggacccatgatgccaataaactcacctgccttaacctgaaagctaagatcgtttaaggcccgaacccgatcgtgacgctggccgaaaatcttacttaaattagatacttccaaaattgccatgggcttacctccgtcatcatcataccaaaaaccgccacattcaacatgcctgtgcgactatcaagctttctaaacaggacaggttaaaggcatcagaaaaagttccgagaacgtttcaccataatatgctcaccggcgcagggatctgcgtgtaaggaccttgggcgcaatggccaagaccacttatgttctaacttacgcccataacgcgctccccggcgcagaagtctgcgtgtaaggaccttaagcgcaatggccaaagcccggccatcacgcttaaggccacttacactccgacttctaagcgcgccggctcgcgctcacttttgtttgtgtctcggccacaaaacttgtacgataagttcaggaatggagttggtcgcgtgtttaaaatcatgattgtagaagatgatcagacaattagcggtcttatcgctgacaacctcaagaagtggcagtttgagcctgtcgttgtgactgattttaacgctgtcttcgatgattttctgcaggaaaaaccacatttagtcttattagatatcaatttgccggtttttgacggctattattgggtccaaaagattcgtgaagtctcaaaggtgccggttattttcatctcaagtcgcaacaccaatatggatatggtgatggcaatgaacatgggtgcagacgactttttgaataaacctttcgcgatggaagtcctcatcgcaaagatcaatgcgctgttgcggcgaacttataattatgccgatcaaggaaccgatgtccttgaacacaatggactcatgctgaatctaaaaaacggcatggcccaaattggcgaaaaggaaatcaatctgtcgaagaacgaatataaattacttcaaattctgatgcggcaacatggccaaattgtcagccggtcaagacttttgcgcgacctctggcaagatgaacgctttgtggacgataacacgctcacggtcaacgttaaccgcttgcgtaagaaaatcgaagaagcaggattgaaagactacattcagactaaagtcgggcaaggctatatcgttccctaggaggcagccatgcgttttcgcgattattttaaagatcatatttgggcgattggcggctatattttatgcgtcggtttagctgccatcatcgtttggctggatccgcaacaccgcgttaaattggcaacggtctggtatgcggtcttactcgtcacattggttgcaagtgccttctttatcgcgcattttgtccgtattcgccagtttgctgctcgcttgcaggcgcgccggaatgctgaagatgctgctttggattggccgctgccgggtggccaatccggactggaacaggttgtctcggatacttacaacaaaattctgaccttgcatcggcaacaaatcaccgcgcttttggcccaacatcaagaccaaaaagatttcattgactcgtgggtgcatgaaattaaagtaccgttggccgcggtttcattgcttgccgaaagttttgaaggccaggttcccgatgacaagctggataacctcaatttacaactggatcaaatcgaattttatgttgagcaggtcttatactattcccgacttgacagcttttcgaaagattacttgctgcataatacgcaattgaaaccgctgattaatgacgttgttgccaatcaacgtaatggcttcattaacaaacgtctgtcatttaaactgaacggcgatgaccaaaccgtcttaacggacaataaatggctgcggtttattttggcacagctcatttccaatgcagtcaagtataccccagaaggtgggcgcatccaggcaaccattcgcgacaccggcaaggaaacccagctgatgatcatcgacaacggcatcggcattcctaaagacgagcaacaccgcgtttttgaaaaaggctttaccggtagcaatggacgcctgtcaaatcataaatcgactggtttgggactattcttagcagaaaagttggccgaaaagttagggcatcacttaacgttgacgtccgtgatcaatcaaggcacaacggtcaccattcattttccatatgtcagctattacaatgatgctggtcaaaccgttgaacatcccaaaaaggcacttcatcaaacagcagatacatctgattcatccaaccaaaatgagtaggacattcttctttaacgaataaagcgagtagctaagcacacgaccgtcattgttgtcttgtggctagctactcgcttttttatctgtctatattttgtttgcagcaaagaacccaaccaccagcggctgcgactttaatcagggtcaaacttttatcgaatgaggtttttccaaagcttgatctcacccgccgcctgggttgccggcacatcaataatccgttgattggaactgccgcgaaattgcagcgttaagtctttttttgccaacaggaagcgcccatccaccaatatatcgatgaggctcagcagcgttaacttgtcttcagaatcctgcatgagttcttcgtaagtgtaaccgctccaactccagatatccttatcatgcccaaactcttgacgaatccggcggcaaagacgaatgcacacctgagtattcaagaaaggttcaccgcctagcaaggtcaagccttgaacatatgactgacccagatccgcaataatccgatcttccagttcctgagtgtatggctgaccataccgaaaattctgggcgacacgattgtaacaacccgggcaggcaaagcgacagcccgagacatataaactacaccgaaccccttctccatcaacaaaattaaacggcttgtaatcagcaattcgttgttgtgaaagttcactagcaagccattctttcggttgtggattctgcggtaaacgagctgtggtcatcataagatccgcatcgttttttatggtcattttcttaaataatgggcatcgccttttcgctactaaacaacaaaagcggtaaataccgatttatcgatggttaaacatcttatctgcaaagtaatcccaataagtctttgtgccggtgataacagatgcttggccggctaatccataataaagggactgccgctgcgatttagataatttcacccgcgccttgaccgtaaagaagttaccaactttc

SEQ ID NO: 9 - DNA, 2802 bp, Lactobacillus rhamnosus
ttggtcgccttagtggatcctcaaccaactgccatgcttcttcaagtgcttggcgaagggcttggcggcatcgcttcaaatgcgcctaccaattgccccagttcatcggttgtcttggcatgcagttcaaaatccagatcctgagcctgaatatgtgccacccccgcctttaactgggctaacggcggtgcaaacttaagccgataaaccatccgcgccattgcattcataaccgcatataaaacggcgaagctaccaataatcgctccgccaaaatacaaaccgacaccgcctaaaaaccagtgagtcgctaaagccgtcgttaagtgaaacatcaggagatgccagacttgtaaaaatagcaacatcatgatgccggcgacaatcgttcctagcagaatcatctgtaaaagtgcttttttaatcgatagcttcataaagtgtgcttttaattttgccatttatatcccactccccaaaccgttacgatgggcgatgttacctgacaggcatcaaagagcttgcgaatgcggcgaatgtgctcggtgatcacccgctcatccccttgtgcatcgtagccccaaatcttttcatacaattgctcgcggctaaacacctgccccggattcaggctcagccattcaatcagctgatattgcttattttcaagttttaggcaagtcgtatccaccgagacctgatgcgcatgataatcaatcatgatccgtccaaaaacggcaatctgcgcctgtttgtccggctgatgggcccgtctgacatgtgccttgatgcgtgcacctaattccgtcagactaaacggcttggtcacatagtcatcaccgcctgcgcctaatccctgcaccttatcctgatcggtaatacgtgcggttaaaaagataatagggacagaagtgatcgcacgaattcgactggttaaggtaaagccatcaatatccggtaaattaacatccagcaaaatcaagtcaggctgctgtgccaattgactcaaggctgcttgccctgcatctgctgtcagtaatcggaactccggtagccgccacgcaaaataacgctttaacattgccaaaatagcagcatcatcatccaccgccagtaccttcgtctgcatgccttcaccctccattgccccaagcctattagctccgcacttatatcgattatgattcattgcaaaataagtgtttcctaattcaactctacctgttgccgcaaccgcttgcaacaaggcatctgctgggtgatattaaaaaagcactgccagctgctggcagtgctcatgaactaacattaaattccactctaaacacggccagattaataccgaatccggaaagttttaggcgccactcggtaaatcaccgcggtaccgatcccgacataaagcaacgtcaccgtaccaatgagaatcgcatagccatagccgtaaaaatgaatctgcgtaaaaagccacgccacccaatacattccccaggacaagaagcggtacagcggcgatacaacatccatatcatccgtaaatggctgcatcagataataaataaagagatcatgaaacgaaaagaacaacaccaaaccacagatctccagcaacaacaccagataaaagttgacctgatcggctaccggtgcgattaactgcagtgcaaaaatcagcaggaaaaccgtgaacccagtcactgcattgtattgaacaatgtgccaaaaccgataaaagaatccggctaaaatggtcttaggctggcggtaaaaaggataatacaacattgccgcgtcacaattaacaaataacagttgaacgatttggccacccagcgaggtcaaatacatcaaaaagaaaataccaccataaatcggcgtcagatcgcctaaattatggacagcgaaaagtttcaatgcgatcaaaagcccaccgccaagtccaataacccacagcagacgggtccgcaactttttccatagctggcgacgataacgggcaaacaacaaggcattgagataattactgccggaacggttttcagacttgagggccacggtggtatccagcgtcagtttcttttgcattgcagttcctgccgctagaagttgctgctttttggctgaagcaacaagatttaacgcccgcactgcagactgaatggaggccatgattaacgaattatcattcgaaaaacggtaaatgtaccacccaatcagcaccacactagcccatgcaatcagaaagcccagcggcgaaaaaacgccaaacgtaaaggcggctaattttccggttactactaagccaatgggtagccccagcaaactcagccaatacccaatctgcaccagcaatcccagccgccagtgtgcccacagcagccgtggaatgaaactcggccataaccacccaataatggcaatcggcagtccaaccaaaaacagccacatatgctgcgtcaacaaggcgagcgcaaacataggcagtagtggcccaagtacaacgccgctgatttgatccatcagcatcaacccgcgcaccagtgccggccgatccaaggcaaaataatcccctagtttaaccgacttgagactcagcggcagattgcggaataccaagccgcgaaacatgagaaaacccgccagataaaccagtaccgcgatcatgacgcgaagtgaaagatcggttgccagtggatgcacataatcgtgatacgcactaccaaccaaaaatgctagcccgatcagcaaaagcgttgtcaccggtattagcaaaatcgtgaaaaagttaactgcaattgccat

SEQ ID NO: 10 - DNA, 3045 bp, Lactobacillus rhamnosus
ttgaagctaccgtgtttggcgaggttcaacagatcttcggtttcatattcgtacgtatcgatcccgacgccagccagtttaccggacttcagattgctgagcatcgcctgggtatcaatcagattcggccgcgcggtgttaaccacaatcacgcctggcttcataagatcaaacgctgcctcgttgataatgtgggtattttgtttaatgcccggaacgtgaagatcaatgatgtcactttgtttgaatagttcttccaggctgacatattcaaagtccggatgatcgcctttcatcggatatggatcgtaagcaatcactttggcaccaaaacctttgaagagcttgatagcaacgcgaccaatgtgcccggtacccatcacgccgactgtttgctgaccaagttctttaccgatgaaggtgccggctttttcgtagtcgcctgcctgtagctgtgcttgaacctttcccatgttgcgaagtagatataacgtatcggttaacgcaaattcagcaatggcagccggtgaatatgcgggaacattacttaagcgaatgccatatttattcatcgccgccatatcgatattgtcggttccgacattgcggatggtgagaaacttgatgccatattcgtgcattttttcaaacacaccagctgcgtatggcgtcgtttgtagtgagttaatgccgtcaaagccttttgcccattcaacagtatgctcatcaagaaattccgtatgatattccagcgtgttgccggtttccttagcccactgcttgaaatattggatctcatccacgcgtgcaccatatgcaataatcttcatattctcaatatctccttgatttcgatttgtccattcatcagtatacaagattatgctcgtaaaatagaacgtttaaccgctaccttttgaaaaacttactactgattaaaaggttggatgctgcccttgttccaaagctaacaatttgcgtttcaacgttaagccaccgcgaaacccgcctagtccgccatctgtgcgtaatacgcggtgacagggaatcgccatcattaatggattccgcccgacagcattgccgattggcctgaaaagcacgtggccgatcaactgctgcggcaacttgtttgtaagttcgggtttcaccatatggaattgtcatcaaataacgccataccgccacttgcagttttgtgccatgaaagactaacggcaccgcgatctcccgactgtcaccgcttaaataatcataaattgcattgcgaaaaggcaacatctcctcgcgatcaaataccagtggccctttgatataacgcgttgcttcgcttagtttggcatccggcgatccgacaaaagcaagcttaccttgatcaaccacaatcaagtaattgtgctcaggcatgtttagccatgtatattgcatagaaaaatcctttccattaaaaaatcgcccactcagaaaaaatattatcgcgaatctcgttgctatcagtgatgccagcctatccacctaatcgctaagccatgacaaatatgtctgggatcagtatactgttcagcaaacaacgacccatcgacccgcagcgtaaaacccgacttacacgtaccaaaaaggagagacttactttggtcaaaatcctagtggttgaagatgaccgcaactttaacgacctgattgcaaccatcttacggcagaatggttacactgttcaaggtgccgaaaatccaccggcagcctatgatttactgcaatccgaacaattcgatctcgtcttatcagacatcatgatgcctcaggtagacggttatcaatttgcacaagaactgcgccgaaccgatccaagcatccccatcctcttcataacggcgcgagatgatattgcgtccaaagaaaagggttttaatagcggcattgatgattatatggttaagccgataaacttcaatgaattgctattacgaatcaaagctttgttacgccgcgcaaaaattacggccgacaacttgttgatcgttggcaatctcactctcaacaacgaggcgattactgcacaagtcaatcatcaaacggttgatgtcacagttcgggaattccagatcctttataaattgctttcatatcctgatcacgctttttcccgagctgaacttatcaacgagttctgggaccttgccagtgataccagcatgcgcgcggtagatgtatacattacaaaactacgcgagaaattcaaagcagcagatggctttacgatcaagaccattcatggattaggttacaaggcggtgttaaccttatgaaatcagtaaatgagcaagccgttcaaccacaagtaaagcaacacttttcatggtttcaattctttggctccttctttaccttgagcattctagcagccttaccgggaatactttatggtaataattggcatctagtgttgacgccgttattaggctggtatctgctttactgggcattggtcgctgccggcttctccgcattcaccgcctggcagaaataccgcgcttttgacaagccacttaaagctttgagcgatgccgctgaacaagtagcaaatggtaactttgatgtttatttacaaccggttcatgcaccccagaattacgactacctagacgcgatgtttgctaacttcaatattatggtcgccgaactgggctccaccgaaaccctacgtagtgactttgttgccaatgtgtcacatgagttcaaacgaccgttggcaaatattcaaggttatgcccaagcattacaacagtcagggcttgaccggaaaacacagcaactttatttgaccaccattagtgattcggtcgcccatttagcaacgcttgtcacgaatattctaaagcttaacaaactacaaacccaagtcacggcacctgattaccaaaaattcgatctcagtgcgcaactgacgcgctgcttactggatgatgccaatgcgattgatgctaaacagttacatctaacaattgatttacccgactcactgccaattatcagtaatccccaact

SEQ ID NO: 11 - DNA, 1701 bp, Lactobacillus rhamnosus
aagttcggtgagatagtctttttgctgcgtaatacgactttcaaaatttgtcatccatttagtcaaagtttcagcgtttaacatcagtatccccccagccaacagtgtgtgcagatgcattcagatagttcaaccattgcggatcacccggccaattgacgaaatgaaaaaacaggcgattcggatggcgcgtggggactattccggtcaggttcgagtttacgggcaggatgaacttggccagcttgcagtcgccgtcaataatctaagtgtgcgtgttgaagaagcccaagaagcctccgaagcggaacggcgccggttggatagcgtgttggctcatatgaccgatggcgtgattgctactgatcggcgcggtaatgtcatcattattaatcagaccgcgttgagttttctcaatactaaaaatgaggatgttattggcgtttcgattttgaagttactcaatatcgccaaggattatactttgcgtgacttacttgagcaccagactgaattgttgttggatttttcggagcaacttgatcatgatctgattttgcgggttgattttagcttgatccaacgcgaaaccggctttatttcgggactggtcgcggttttgcatgacgtaacggagcagcaaaagattgatcgcgatcgtaaggaatttgtttccaatgtgtcacatgaattgcgcacgccgttgacctcagtgcgtagttatattgaagcgttaagtgatggtgcgtggaaagattctaagctggcaccgcagtttctaaatgttacgcaagaggaaactgaccggatgattcgaatgattaacgacttgctgagtctgtcgcgtttagattccggtaccagtaagttcaaccttgaaaccgtcaatttaaatgagttcttcaactatgttctggaccgattcgacatgatgctcaagacggataacgaacacaccggtgaggcgcggactgcacaaccgttgccacagccggatggccaaaagaagcgttattcgattaagcgggaaattacccacgaagatctttgggttgaaatcgatacagacaagttcatgcaagtgattgataacatcatgaataacgcgattaaatatagtccggatggcggcgtgatcacagcacggttgttccagatgcacgatcacgtgattttgtccatcagtgatcaagggctaggaattccgcgtcaggatctgggtaaaatttttgatcgcttctatcgcgttgataaggcgcgctcccgcaaacaaggcggaaccggtctaggcttggcgatttcaaaagaagtcgttgaagccttacatggccgcatttgggtcgattcacaagaaggccgtggcagcacattctatatctcactgccatacgaaccgattaccgatggaggagatgactgggatgaagcttagtagttggattttgcgcgtgagtctgatcgccatggttattttaagcctcgtctttacgtcattgatttggcgaaatccatcgcggctggagcgtcgaagtacatcgaacgtgcaggtaacaaccgaaaacgatccgaatgttaaaaaaaatgggaaggcaacgtttacctgcctaaccaagtttattacacgcatcgtggtcaaaagcagctgctatttaaagccaatgccaatatcgaccatgaagttcaacaagcaatggcggattg

SEQ ID NO: 12 - DNA, 2458 bp, Lactobacillus rhamnosus
ttagacgctggactcgcttatggacgactaatctggccactggcgttacgcactactttcattttagtcatcggaatgtagcccattttctggaccagtttcttctgaatggccggtgacatcatgtaagtcaaaaatcgtttggtcaaaccacttggccgaccttttgtatacatatgttcgtacgaccagatatgccagcgattcgttgccacgttactatcagttggtgcaacgccgtctacagacaagctgcggacggttttatcaacataagaaaaagcgacgtaagaaattgcccctggcgtactgccaacgatttgtcgcaccatcccggtggaatcctgttcctgagcggcaatcggttgcttgccttcaagcgcccatttttcaaaagtcgcgcgggtccctgaaccttgtgcgcggttgacaaggacaatcggcacattcttgccacctaactgtttccagttggtgatctgacccaaaaagatctgttgcaactgcgtcattgacacatttttcacaccgactttgggattaacaatcggcgcaatcccgacaacagccactttatggtccaccaaggcgttggctttaatgcccggtttttcttcagcaaaaagatcttgttgaccgatatcaaccgccccttgctggatatggcttaatccggtaccgctcccgccaccttggacgttgataaacacgccgagatgttccgtctgatattgttcgcccgccgcttcaaccaaaggctgcaaggcacttgatccaactgcggtgattgattcaccagactgtttcgaactatgactgatgccacatgcacttgctaacagcgccaaaaatacgatcgaaaacagggtcacaatttttttcacacgaaatcctccatttcaagctccaatcatcttaacagttgcgtgtaaatgttcatgtcgttgaatgtaaaggttctgtaaatatgtcatcagtcttgctgctggcgcttgctgatcggcaatgtcacggtaaaggtcgatccaaccccgacttgactcgaaacggcaacctgaccatccatacttttcaccagctcactaacgattgcaagacccaaaccagtaccgccattgtgacgactgcgcgctttatcaacccgatagaagcgttcaaaaatccgtgcctgctctgtctcgggaatcccaataccagtatcagcgaccgccaatgataagtgcccttcgactacttgggccgtgatcgtcacatgtccggctaatcgattataaaacacggcattgttcaaaagattccgcacaatctgagttaacttgcgctcatcggtcacaacctgtaagtctggtgcaattgccacctccacccgaatctgcttgtctttaatcactttagctaaattacgcaatgcatcgtcgactaacttcttaagtggtacttgtgcctgcaccgtttgattcgattcgggccggctcaacgttagaatatcattgatgagctgggtcagtcgcttactttcatcgaaaataatcttcaaaaacttatctagcgtcgccggatcatttttagccccgcttaatagtgtctcggcaaacccggaaatagcagtcaccggcgtctttagctcatgactcacattgccaacaaaatcgagctgcattttctcgacttggcgcaaatacgtgacatcgtacaaaataaccaacacctggagacgactagttccttggtttaaaggaatgacactggcatcaaccgacttttgggttgccaggacggtcaactcctgatgatgagtcttttcatggcgaaaagtgtgctcaatcatccgggccaacgcataagtcttaacatcgtccagataattgtgccgcggctgcggaatctgatggcccaaaagctgggacatggcatgattatgcaaaatgacatccttattggtatcaatcaacatgacgcctagtggcaaattatcaatcagacgatcaaaactggactgccgtactgcgactttctcacgtaaatgggtttgttccgcagctaaggcattaattcgccgtgccacaagcgtaaacggcgactgtggcggcagaatcacaggctcgggctcttttttctggcgaatccgatccgagtcatgatgaactgctgcaagaaactaaacagtgcgctacccaaatacagcaccaagacgattaaaataatctgtttgatcttatcaaaatcaattggatagttgccaacagcgataccggccttttgctccgcttggcctttcataacccctttaaaaatctcgggtgtagctttccctaggatttttggcgtgcgaaatttgaaagacggtccgaagccatgggccaaactagcaccgcaatataccaataagacggttgggcatggtacccaatacccggctgtggggccccaaaatttttcggttttcaacaaaccacca

SEQ ID NO: 13 - DNA, 2525 bp, Lactobacillus rhamnosus
ttattcaattcgtccatcatctgggaacggccttggtctttagccatcaagttctggatcgggtggatatcacgcatcttgtcgtcaagtgcctgcagtgatttcacttcttcatctgtcaaatcctgtccctgcattgacttttgatgcatctcatatagctttggctggaactgctggaacaagccatatgcaacggcgtccaattgcaaaagatcaaacgccttcttaagatcttggaattcctgagttgtcttgatatatgacggcatttgatttgccgtgacatgaacgtttgccatgctgtacctcactatctgagcctatttgaaccagctcttagatagtatcataccattgtgccacagattgcttggcactgactatacctctatcgatactgtatggaattccttgccaagtgtcatcactttttcccggtgtttggatgctggccatttgggcggcatccttggtgtcaaaggcggtttgaggtgtattgggcatcagcttcgacatttcaagcttgaacaacggtgcgacaccggatgtgctggtaccttgcaaaaagtgctgactatccgttgtcggataaccaatccaagttgcattcacaatatccggcgtataaccaactacccactgatccttggtgccataaccccaactgctaggaacctcggtactgccggttttaccagcaattgtatagccagacggttttgccgttttcccagtgccttcgttaaacgtaccgatcatcatactggtcatttcctgagcgacttttttggacatgatctgacgcgttgccggatgggaattatcaaccaccgtttcgccgctcgcatcaacgattttccgaataaagtgcgtggtcggcagcttgccatcgttagcaaacgccgcgtatgcccgcgccagcatcaacggtgaaaccccgttttttaaaccgccaagagctgcggctagattctgatcactcgatttgagctgaatgccaaaacgatcaaggctggcaacgcctttttgcaccccgagtttgttgagtaaccaaacagcaggggcattgatcgaatccgccagtgcttgatacatcggaacggtgccaaggtatgtgccagtcgcgtttgtcggggtataattatttttgccgtagctaagcttttcgtctttcagaatcgagtcgtagtgatacccgttttctaacgccggtgtgtacaccatcagcggcttgatagtcgatcccggcgaattacgcagctgagtcgcgtaattaaaccctaggaaggtatgttcgccccggttgccgacaactgcgcgcacgccgccagtcttgggatccagaataatcgatgcgccttgaacctgtttaccatctgctgcattagccggaaatgcccagtcctgttcaaaactggtttgcagattctgctgataggtttgatccagattggtgtagatcttatagcctttattcagaatatcatcaacgctaatcccctcactgcgcgcttcttcgatgaccgaatcaaagtaagatggatatttctgtgcgttggcgtttgaaaaagcatccactacctgaaccgattgcgctttagctgcatttgcctgcgcctgagtcaatttgtggttatccaccattagctgcaaaaccacattacgtcgcgaaatcgcgttatctttatgatcagccggattataataactcgggttacgtaacatccctgctaaaatggcaccttcactggcatccagttgactcgcattcttgccgaaataacgttttgcagcgtcctgcacgccccaaaccccattaccaaaataggcattgttgagatacatcgcgagaatatcctgcttggagtaaactttattcagttgaattgccatgaatagctcttgtgccttacgcagcatggtctgcttttgcgtcagtaacgtatttttggctaattgttgcgtgatggtgctcccaccacccataatttgaccatgatggataacatagttcaacgccgaccgcaaaattcctttaatggaaaagccgccattcgagtaaaacgtccggtcttcggttgaaataaccgcattttggacttgcggactaatcgcactgagttcaacatacgtccctttttgaccgtacaatgtccccgcttcttcattgttggcatcgtaaataaccgttttggtctgtaaggtgctcttgatattttgaacatcagctgtttttgctttataagtgaaccaggcagagaagattaggatgaccgtcaacccaagtaaaatgagccagcgaatgacctgaaatcggcggaagaaccaccgaatgctctgccagacacgtgatagaacctgcatgtccttcctcctattatgaatcttatttattgtagcataggccgttgtcagccaagtctcgaccggctgtttttaagcaaactttatgaccaaacgaatcgaggaacctttttgttatttcaaacatccgccattgcccagaatcacgccagcctccg

SEQ ID NO: 14 - DNA, 7818 bp, Lactobacillus rhamnosus
attcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaaggtaaacagtcaaaaagccctaaaccccccaagaaattatggcggcggattttaaaatggaccttgctcggcttgcttctcattttcattgccggtgtcgggttattctcctggtatgcaaaagatgcacctgaagtcacccaagcaaaactcgaatctggcggatccagtacgatttatgatcgtagcggtaatgagattacaacgcttggactggaaaatcgcgactatgtcaaagcttccgagattccgcaacaacttaaagatgcggttgtttcaattgaggaccgccgcttttacgatgagaaattgggcattgatcctgtccgtattctcggtgctgcttttaacaacatgaccggaaccggtgatggcttgcagggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatttgagtcttgcacaaacggctttcattgccggcctgccgcaaagtccggctggctacgacccttatgagtacccgcaaaaagcgactcagcggcgtaatgcagtcattgatgccatgttacgcgataagaaaattacggccgctgccgccaagcaagctaaagccacaccgattactgatggtttacagccaaaacaacaacagacaaacacaaccaccaatgataaagtgattgattcttacttgacgcaggtgattgcagaagttaagaagaaaaccggtttgaatccttacacggacaatctggatatttacaccaatattgacatgagtgcccaaaaacggctctacgatatcgtcaataccgatgattatgtcagtttcccggatgatgccttccagaccggcgtcacgatgacagatccggataacggacaggtcttagcgcaaattggcggccgtaaaaccggcgatgtgcggttagcatacaaccgggcagcgcaaaatacccgtagtaatggatcgacaatgaagccgctcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgaacagtcccgcaacattccagccgtcaaaaccttgagtgcagttggtatgacgaatgccgtgaagttcttaaagggactgggtatcgacttacctgcctcagaacaatatctttccagtgcgatcggggcatcggtcaacacggttgaagaagccggagcgtatggagcctttgctaatggcggcacttattacaagccttattacgtcaataaagtcgttagcgccgatggcaacacccaaacatttaacagtcaaggaacccgggcaatgaagtccagtaccgcctatatgatcacggatatgctaaaaggcgtgttgacaaaagggacaggaacctcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccatttcccagaagatctataaggcactgatgagttatacctcccagaaccttgataataaggattggacaaagccggatacagttgagtcgtacaatattctaaaaggcagcaatcccggcacagcgattacgagtggctcagccaacaccacgaaggagttgtacgttcgtggtcatggaccaagcagtcataaagcagtggctgaatcatcatcttcttccagtgccagctctgaatccagttcctcaaaagaatccagctcagaaagttcaaatgctgtttccgccagcatcgcgtcacatgcgacatcttccagtgtttcttctactgcgcctagttccgcagcaccttcaaaagaagaaacaagttccagcagtgagcctgtctcatctgctggtggtcctggtggtaatcaataagatttattcacgtgatttgaccatcaagagttttccctgatgaggattgccggacatcattaaaaaagcaccgctaccgatttgagatggtcagtagcggtgctttttatatgtgaaactaagcttgctgttctagatgaaccacggccacatggtgctgtgccaataacgtttcgccatacggatcattgcgatagtcatgcgcatacacaacacgcttaatgccagcctggatcaaggcctttgtacaattcaaacatgggaaaaagttaacgtagacggttgcgccatgggtactgaccccattagccgcacattgaatgatggcattcatttcggcatgtatggtccgaatgcagtgaccatcacgcattaaatgaccggcctcatcacaatgcggatcaccactaatcgcgccgttataaccggtcgcaatgatccgatgttcctgaaccaaaactgcccccaccgttgcgcgctcacaagttgaacgttctgaaacctttttggcgagttcaagaaaataatgatcccagctttcacggtgaaccgtacgcttggatggcataatggcatctgtcaatgttcttccccctttaatggcgcgtaatgggtagccagaaacgtccattccggtccggatggtggctgtgggtctcgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactaacatgagtatcaactgccacgcccggtatgccaaaagcatcgctgaggaccacagtggcggtttttttaccaactcctggtaatttgaccaagtcagctgcattggctggcacctgaccgtcatatttttcaactaaaatagcactcaacgcttttaaatgcgccgctttagttcgatataaaccaagacgactgatttttttggcaatatcggtgactgaagcagcagccattgccgcgggcgttggatacgcggcaaaatatttcgggcgtaaccggattaaccgcttcataccggtgtttgcgcccgaaagcttccatgtgcccttgaaatttgaaaaggaatttttcgcgtgtaatgtcggctgtgggtcaggatacaacgccataatttgctcgaacaattgtcgggcttctgaatcagtcacacaggttcccccttttaaaatcggtttgattatgaatccggtcttgcctaatagttaaagttcttgatgacgcttgagctcggcttgaacctgttgcgcggttttaagatgccgtcgttcccaattcagcaaaatgcgatccatgtacttcagtgaatacgcggcattcaaaacggcttcacgtagcgccaataagattacttctggcaagtagtgatccgtcgttaaccagtcgcgaatcgtttcctgttcaattggtgaaagtggtcggccaaattcaatttcaatttgattaaagacattcgtttgcgcatcggcatttggttgggacattacgctgctatggcttttttggtttgtcggtatcttcgccagcaacggcgtgagatcatagtggtcgcgcattttaccctgaccatccggaatgctttcaagaacaatcgcctgtttttgaatcaacgtttcaattgctgtatagattgcattgggtgcgacgttcatgcgcgctgccaatgccttaagatcaggggcttgatgatgcttggattgccactgatcaatgaacagatacgttataaactcggtttgggtcagtcctaacgtaggatagtcatcaaacagcagattagaaacattaaactgtcccgcttcgatgtaccgttttaaatcagtcatgataggaatcctccaaaaaaagccggcgcgttggcgtccgacttttggttgccattacggctttaggcgattgatcattcgtgggaatgggatggcttcgcgtaaatgatccaacttgcaaatccaggtaatggcgcgttcaaggcccaaaccaaatccggaatgcggtactgaaccgtacttgcgtaaatccagataccattcgtattcatctaaatcaaggccggccttttcaatggcagctttgagcttgtcataatcggtttcacgttccgaaccgccgatgatttcgccgtaaccttctggtgctagcatatcggcgcagacatattgctgctcatcttccgggtccgttaacatgtagaacggtttgatggctttaggataattcaacacaaagacaggctgatcaaattgatctgacagatacgtttcttccggcgagccaaaatcatcaccgtatttgacgtccatccctgctgcctgcaacatttcgattgcctttttgtagctgatgcgtggatatggcagcttcgtatactttttgagtacttccggatcgcggcctagcaaatgtaacggataggcgcagttatccaataccgcctgcaccatataggcaacataacgctcttgaacttttaaactctcttcttgatggcaaaacgccatttccggttcgatcatccaaaactcggtcaaatgccggcgggtcttacttttttctgcccgaaataccggtccgcacgtgaagactttaccataggccattgcccctgcttcagcatacaactgaccggattggctaagataagctttcttgtcaaaatagtcagtttcaaaaagttcggttgtgccttcaggtgccgaatcagtcaagatcggcgggtccattttgataaagccttcattgttaaagaattcaaacgtggcgcgaatcatttcgttacgaatttgttgaatcgcaaattggcgctttgatcgtaaccaaagatggcggtgatcgagcaggaactcaatgccatgctctttaggcgtaatcggatagtcgtgtgaatccccgacaagctcaatgttgcggacttcgatttcgtagccaaaatgactgcggctatcttggtgaatgacgccggtgatccacatgctggactcttgacgtaattcctttgccagctgaaagacctcatctggcacgtcggctttagaaacaacgccttgaaaatacgcggaaccatcgcgtaactgtagaaaggcaatctttccggagctgcgtttatcggttaaccacgccccaattgttacttcttcgttcacatggtccttttgcatcaataatgcgaatcttttccgtcatgcgttaactccccacttcaataattatttacaacaaactcccggatacgccgggcggcctctttcagactggccaaatctttacaataactaatccgcgcatgatccggcatgcccaaacgcccgtccaggaacaatggcaaccccggtttcggtcaacagtgcactgataaaatcatcaaccgtaccataatgactcaattgagcggcacgcttaatattcgggaaaagatagaaggcgccttgcggtttatctcccatatcgaaaccgggaatatctgccagaagatcatagaaaagattcagccgttcttcaaaagcacggcgcatcttttcaacaacctgctgatcgccagttaaagctgccaccgcggcgtattcggaaactgctgccggattagaggtcgtgtggctaataaaggtcgccatggcctgaatcagcttttccggaccggccgcataaccaatccgccaacccgtcatcgcatatgacttggagacgccggaaattaaaacagtattcgctgcgatatcgggatcgatactaatcattgaggtgtaagtcgtaccgttataaatcagatctcggtaaatatcgtcagtcactaccaaaatatgatgcttcagcgcccaattgccaattaaggtcagttccgtgcgatcatagacaacgccacttgggttttgtggcgaattgataatcaatgcccgggttttatcggtccgagccgcctcaagatcatcgacactgactttatgtccgactgccggcatgaccagatgtggcacgccgctcgccaatttaatctgttcctcgtaggaaacccagtatggaacaggaatcagcacctcatcgcctgggtttaagaaaacctgaaataaggcatacaaagcaaacttagcgccggtggttgcaacgatttgacgatgatcataacgaataccgtcttgggcaaatatccggtcactaatcgcctgctttaattccggaataccggttgctgccgtatagaaactggcattaccagcctgaatcgccgcaatagctgcgtcatcaatcgccttaggggttgaaaaatctggttggccaatagacaaatcaatgacgtcggcaccttttgcctttaagtctttcgtctgattacttaaggccaatgtcgctgacggtgcgacgttgaggattctttttgctaaatgcacgactgcgcctcctacagcttcggcaccattgcggctaccgaatcatttttaattataaatttttgatcgcgttcaattgttcgccgctgcgaaaactgtacgtcacgtagttcagtttaccagactttgacagatagccaatatcccagacaaattccgatcctcttttacccagtgatgcattcagaattttcttgggagcgctggtttgggtcacctgttgaatggctttttgccgggtaataccggacttttggtttaaaatcgttaccttgcctgtctttttctgaatcacgacgtaaaccgactgattcttcttggtttgaccggcaacggtgagataactcttatcacggttgtaccaccagaagccgttcacgttttttaaatcagcccgattggtagcaattttttccgcttggtcgcgcaattgttggtaaggtgacagactcttggcataaattccgatggcagcgatgatgagaacaatcaggccaccgataaataagaatttggcccagtcgaaacgacggtgatgacgcatcggtgctcccctccttttgttgggtatggttggttgagaattaggtgatgataagcccaatgctgttcgtaaacgcgctcacaggcctagaaacctgcgcataggggtcttgattccaaatggccaaagtgtggtaaactcgggcaactttttggtgtgttgaccgatacctttcgtaaacgcgctcataggcccagaaacctgcacataaagaccttgattccaaatgggccaaaacccgggcttttggaatcaaggccacttatgttccggtttctaaacgggcctgttcgcgctcttgcttcttaaccacatttctatgtacccccgaatatcggtgagtggcaatgtcattggttttatatttggtaaggatttttgcattttcttaccataccgcggg

SEQ ID NO: 15 - DNA, 7210 bp, Lactobacillus rhamnosus
tggcgtttattttgcaaccaattacccttcttctggtacctcattcgcacgcgctttcttttttggttcatcttaatgaatgctgtggttattcttctaagcatgcaaactgccgggaatccacatgcgactattttctcactgttttttgatggggtgagttttagagccgcggaaacgcatcaggtcgtgttacctatattatggtttgcatattttttcgcacctttattaatactgctcaacgtcctccaacaactttggcacacccgcacgcttcatcttcggggacttcaaatcccgccgcggaaatttgcagaagtgaatctcatgcttattgccttgatcaccaccatttatgaagtcggcgctatcggtatcatggccatcgccgccgcttttaaccttcatttcggcagttggcaaggattggcagcagtcggcgctctttttgtcaccacttggctaggcgtcttcttactattattactccaagcgatcggtaatcattttagtccgtcattggcgctcatcatccctgcctgtctgctcatcgttagtgcttatacggccattcacatgaatccgcttggttacctcatgctcacacggatcaacgcaacaaacgcttggcaccccatccttgttctgcttggcatcagcagtttgacaacgatgggctacttagccgttgagcgtcacgccagtctaaattaaaggagaaacttatgggtttaattgaattacatcaagtggccaaaacaattaaacgccgccagctcttgcatcacgttgaagcaagcattgagcgtggcagcattacgacacttgaaggcattaatggctccggaaaaacattaattttaaaagcattgctcggtcttatcacggtaacaggccaagtcgtggttgccggaaagacggtcagccctcaagaagcctatccgattaaggctggcattttgatcgaaaatcccagcctgattgatgacttcaccgcaatgaaaaatctagaactgttggcccggctagatcctactatccaaccgcaacaactcgatgacctcctgatctattttgatctcacaaggtttccaacccaaaaagtccgcaaattttcgttgggcatgaagcaaaagctggggattgccgaagcgttcttaggcggctatccattaattgtcctagacgagcccaccaacgctttggatcatgacagtattatcaaattaattgccctgatccaacgcttcaatgcgaacgggtcaacttttgtcatcgcctcgcacgatcacgaatttgtcgaacaggttgcgactcagaagttatctgtcaaggaagggacgatccagcatgaaagttaaacccaagttctggatgattagcggatgtctggttgttttactcggtattattggcgtactgcgctatcaacaggtcaataccaacccgcagcaacgaggcgtcatcaaagaggtgctgattaaaaaaggccaacttgttcatgctgaaaatgtcgactttaaggttagtaaagttcaggttttgaaaaagaaagatcaggttatcgttcctgtgaccctctcgattaaacaaacaggaccggcaaattatggtcataaaaaggacaaccctaattacatcgaaaacatgtggttgaacatcccttatagcatgagcagccaaaccgataccattttcgataaaaacaaactcagggttaaaccagcgatgcatccttcaaccgtgcgccaaccattaaccttgcagttctcagcaactcggacaagttatgatcatcgcaaccaaaaaatgcgcttcagcttcctcgtgcccgttaagaattatcttgtgaagtattcgttgttgctggaatgatgcggctgattagcgttgagtacgtctaaagcaattctacaaaggctgtaatcattgcaaaattcccccggtttcttcccttcccccagaagcgtagaatggcgttatacatggagaagcgtaaaaactagaaatggggaacagacatgaagaaatcgacgcgcaccatcctgattagtgtggtcgcagcaattgtcgtcattgtgggtggcttcggtgcctttcactggtaccaaggcaaagctgaaggcgaccaggttaaggccacggcccaagcctacacgaaagcttttgccaaccgccagtatgaaaaagccgttaaacaagtcgacactagccatctcaaaggtccgggctggcaatataccgccaagacgttggctgaacgcaatcaggccgttttcgaccggatcggcgccagcaacattaaaatcacggatctgaaaacaaccaattccaaagacggtacctatcaactcacttttaccgccaacatgaacaccaagatcggcaagctcccggcacagcattacaccgcgccgatcgttaaagtcggcgacaactggcgcattcgctggacgccaagcctgctgtttccacaaatggatggcaaggacacggttcagattagtttgacagctgccacgcgcgggaaaattctcgatcgtaatggccaggcgctcgccaccaacggcaatgtcacccaagccggcctggtccctggcaagctgggcaccggcgatgaacggaccgctaatctagaaaaaatcgcgactgcctgggatgtgaaaacctcgagtcttgaaacgctcctcaagcaatcctgggtcaccgatgatacatttgtgccggtcaaaatcgtcaccgactcccctgcattaaccggtgcagcttaccaaacaatcggttcacgtacttatccgctaggcgaggccgctgctcaactcgtgggatacgttggtacggcaaccgccgatgaccttaaaaagcatccgtcactgaccgccaacagcaaaatcggtaaagccggtttggaacaaatttatgaccattacttgcgcggtacggatggcggcacgatcgcgattcgcaacggcagcaatagtcatcccttgctagacaccaagccaattgccggcaagaatctgaaactgacgattgacgccaccaaacaaaaaaccgcttatacccaactagcaggtaaaagcggcagtgtggtcactatggatccaaccaacggcgaacttttaactttagcaagttcgcccagctacgatcccaatgccttcgtgaacggcatcagccaaaccaactatgacaaatacgccaacaacactgagctgccattcctcagccggttcacccaacgatacgcaccgggttccacttttaaaatgctaacggctgcgattgccctgcaaaacaaaaccatcacccctgacacaaccaaatctatctccggtctcaaatggcaaaaagatagttcgtggggcgactacaaagtgacccgcaccgttgacgccagcccggaaaacatgacccaggccttggttaactccgacaacatctggtttgctcaagtagcactgaaaatgggcgcctctgcttacctcaaaggtctggagccccttttcaaaacccaagccaacttacctttaaccatgaaaaaggcccaaatctccaacaatggcaagctcgcctccgaaacgctcttggccgacaccgcttatggtcaagggcagctgctgctatcgccaattgaacaggcggcgatgtacagtgccatcgccaatgacggcaccatgcagcagccaaccttgattcaagctgcaaaaggcaaacgtaccagcgtgctccaaagcaatgctgccaaaacggtcaaaaccgccttgacccacgttgtctccgatcaagccggtaccgcccatgacctcgccatcgacggccacaccatcgccgccaaaaccggcacgggcccgaactcaagcagaaacaggacacagacggcaaggaaaatggtttcttagtcgccatggatgccgacaagaatacctacctcaccgtcgccctcatcgaaggcaccggcagcggggatgtcgtgacgggcaatgaagccttttgtggctagtttgtactagacacacttgctatcacattaaaaggagagaaatctcgatggacttgaagagatttaccgaagcgacctcaacggatatggatgccttcttcgccgagatgatgcaagactccagttacagcaagctagccaaatctgaaaaatccaagctggcaagcgcctatgctgttctagaggcaaggcgaaatgcgggattgagccaacaggaacttgcaaacaaatcaggcgttcctaagacaacgattgcgcgtattgaacgaggaaataatacaagcatcgaaacgctaaccaaaatcgcaaatgctttaggcaagcaagtaagggtctcgatagtttaattgataggccgctaacgccaatcttaaaaatcgcgtcaacctcccctttttgtgagaaattgacgcgattttagtctaactgatcttcttcggacacgattaaccttacgcaggatccattttaaccttcgccaaccccgcacgcacctcatcccccatcggaatcgacgggaatgcgccgagcttctggacagtaaacgagctggccatgctggcgtaagttgccgcatcgacaatattgccgagatcgggctgaaggttgctgactaaagcgccgataaaggtatcccctgctgccgtagtatccacagctttgaccttgaaagccgggacgagggttgcctgaccatccagcgaaatgaaagaccctttcgaaccaagcgtgatgaccaccccgcggatgccgagttgatgataatacgcggcggactggcgcatgctggcttcatcggtaaccggaatgccggtaatcaattcgctttcagtctcgttgggcgcgattagatcaacatttttcaacagcgcctctggcagttctttttgcgccggtgcagggtttaagatggttaccttacccgcagctttggcaattttgaatgcttcggctgtagcggctaccggcgtttccagttcagcaaccacaaagtcagccgattgaatcaagccagtcgcccgctgcacatccgctggcgtcagttcaaagttggcgccatgttgaatgatgatcgagttttggcccgatgcttggagcagaatatacgcctggccggtttccgtgtctggcgtggtcgcaacatattgggtatcaatttgatttttcaccaactcgccacgcctgaaagcagcattggcatcatccccgacgcgcccgatgaaattggtcttagcgccagatcgcgccgccgcaaccgcttgattggcccccttaccaccggcagctttagaaaaagcatccatttgaattgtttctcccggctgtggcagtcgttgaatgtgtaaaatagcatccacattgatactgccgataacgacaacatgattaggcataaagacccctccatttttccatttaaaagggaccgaatccggcccctttttttgtttaccttaccgcgcgacattgcttgaccagcatagcatgaagcttacttgttcgcatcctcggtggtgactaatgacagtggtgattcgatgttcttcttaatcgtcttgccgtcaaaatggtcataggctgcctgtagtgccaagcgtcccatctcttctggcttttgcgcaacggtcgcagccatgtcgcctgctttgacggctttaatcccatctgcttcaccgtcaaacccaacaatagtgatcttcttacccgcggctttaactgcctgcaccgcgcctagtgccatttcatcgttttgcgagaagataccgacaatatccccgttaccttgcaaaatgttctcggtaaccgtcaaacccttggcccgatcaaaaccggctgtctgcttcgacacaatgtcaagttgaccttttgccgcgccatcaaaccctttgccacgttcgcgagttgcggaagcgcccggaattccttgcaattcggcaatcttagcattcttaccgagcttttcaatcatatacttcgcggccatttccccaccttttttcgagttggaggcaaccagtgtcaacactttaccgccatcactggaacgatcaacggtgataaccgggattccggcatcattggcatctgtaacggctggcgtaatcgcactgaatcgactgggttgataatcaaaatgtcaacttttttctggatcatatcttcaatattgttgttttgtttagcggtgtcattttgggcatcggaaacctgaacattagttttgtttttcttcgccaaatcctgaatgccgttacgcacggaaacaaagaatggattcgacaatgtggacagcgacacgccgactttcagatccttaggcgctttcttggtaacttttgcatcaccgtcagacttcgaccccaaccccgtgttaccacaagcagttaaggtaaaaatcgcagcagcagcgataacggtgatcgtcaaaaagcgcttgaatgtgtgtttcatgttaattctcctcctatttatgagcgtaaacctgcacgactctgttctggcaaccaacttaaagtgcttaattcgcaaacctctgcctgcgatgaactacccattattaccggaccgccgatcgagtagcacggcgatcagaatgacgatgcctttgacaatttgctgatagaaactggaaatccccagcaagttcatcccgttgttcaaagtaccaataatcaacgcaccgattaacgtgccaaagatgcgacctttcccaccagccagcgatgtcccgccaagcacgaccgcagcaatggcgtccatttcataagaagtaccggcgtccggttgcgctgaactcagccgcgatgtgagaatgatccctgcgattgctgccattaagccggaaatcgtgtaaatcagcatcgtcacaaccttggtgcgcaccccggcaatccgagcggcagtttcattgccacccaaggcataagtcttccggccgaaagcggttttatgcaagagcacaaacaacacgccataaaccacaatcatgatgataatcggaaacggaatgccgaacagatagccgcggcccatgaactggaacaagaagctgttgttcattttcgcgccggtaatgggattcccatttgtgaaaacataggtggcgccgcggaaaatcgtcatcgtggccaaagttgcgataaacggagctgcttttccataagcgattaagacaccattcaacagtccaaacacagcgcctaa

SEQ ID NO: 16 - DNA, 1654 bp, Lactobacillus rhamnosus
tgttccttggtgttcgttgttaagtgttgggcggtcacgcctttacttgcagcgaaaacatccttatcaaattctttgtgtgacgtcttaaccaacttcttgaaccagccattaccaccggtttcaaggttcaaaccattatgaaacacaacatcggcttcactggttgccgccacatcggttgggcgcggttcatactcatgcggatccgtgccgcgtttaacaatactgtacagcttgatcccctcgccgccgacattttgaaccatatcctccaaaatcgaattggttgtgaccacccgcaacgtttgattcgtgctcgctgaatctttttgagccgtgctccgactgttaatgaaccaaaagacaccaccgaccatcacaattaaagcacctacagtaattaaaatcttcttcatcgaataacttcctccgcggtttgagtcgtcgcggctgttttggtccgctgacgcttactgaaactaaagaatgcctgttttggtgaaaagacgaacgagatggcgaacaataccgccgctacgagcacaattgccggaccggatgcccagttaaaggtgaagctgaaatacaacccggtgatagacgaaatgaccccgacgcttgctgccatcacgagcatggtttcaagccgatccgtccataagaaagcagtggcagcaggcgtgatcagcatagcaacgaccaaaatgatccccaccgtctgcaaggccgaaacagttaccaaggttaaaaccagcatcaacgcgtaatgaatcgcagtggtattcaacccataagttttagcaaaggtattatcaaacgatgtgatcaacaattctttatagaacaacaccacgaacaagatgacaatccctaacacaaccgcggtggtcataatatcactatcgctgaccgccaaaatattaccaaacagaatatgatgcaagttcgtagcgctttctgccatcgaaatcaaaatgaatccgagcgcataaaacgcactgaacaccacgccgattgaggtatcggttttgatcttactatttgccgcaacaaagccgatcaacagcgccgcgataatgccaaacaccgaagccccaatcatgacgttgacacccagcatataagcaacggcaacccccggaagcaccgcatgggaaatcgcatcccccatcaatgacatgccgcgcagaataatgaagctaccaatcaaaccggacatgatccccaccatgatggcagtaattaacgcgctttggaggaaatcatactttcctaacgcagtgaaaaattcagctaatgaactcaaacgctcgcccctttcttgggttccaaccagccggttgaaaagatcggccgaaaatgcccgttcgatgttttgagccgtatacacttcttcgaccggtccttcagcaataatgccgtggttcatcaccacgagttcatcaaaataatttgaaactttatttaaatcgtgatgaacgacaatcagcgttttcccggcatcgcgccactgattcaaaatggccatgatttcctgctcgctcttcatgtcaataccgacaaatggctcgtccaggatcatgatgtcagcctgctgcacaatggcacgcgccacaaacacgcgctgtagctggccgcctgatagctgact

SEQ ID NO: 17 - DNA, 2945 bp, Lactobacillus rhamnosus
atcaacacaatggttacgactttgatcaaagcaaaccataattccaattcgccaaacattcgcaccgaaatcagatttgccaaaacaaggaaggtgatcttccttcttctgtccattagcaatccttcgtagttcgtcaattgcatctcgtccttcttgactcaaccgtacactttcagtcgtgaggataaaatcaattcttagtatcatccgaaaaacatgccgtcgtaattcatagccatgaaaaccatcgcggataatctcttccttggttctttccacaacttcttcaatattcgtttggcggatgagctgcggttgttcatgtaattcatgcaacaggcagtcgatatagccttttgtttctaattcttcctcgtaatccatacgccgatcaccgcctttcatttgactaacttgatccgcatcgttttttatggtcattttcttaaataatgggcatcgccttttcgctactaaacaacaaaagcggtaaataccgatttatcgatggttaaacatcttatctgcaaagtaatcccaataagtctttgtgccggtgataacagatgcttggccggctaatccataataaagggactgccgctgcgatttagataatttcacccgcgccttgaccgtaaagaagttaccaactttcggatcgcgtgttggggcgacgtcaatcgcataaacccggccatctaatatggtaggggtcggcacattctcagcaattcgcaggcgtactttctgcccacgcttgatgctcatgatctctgtcggcgaaacgcctaattttatgtcagcaaccgtttgttccgttaaatccggcagaattcgtgccaacacgcttcctgaagggacgtattgattcccggccaaggcagtttctaaatgcaaaacgccactggcacttgctttgacatgatagttttgagtttcatcattcaaggtagctaacttagcctcgtctgcttggacctgttgctgaaccttcgtctgttccgcaacggctgtttgctgcaaccgactttgtaatgcggttagattagcctgagtctctcccgctttttgagccgatacatctgcttgtttttgaccggcccgttgctgctctaaagacgtcaaattggtttgttcctcatccaactgtgtctgtaattgagcaaggtactggcgtttaaggttcgcctgtgcctccgcgtcggtattttttatctcactttcatattgttgataaaggtagtgataggcgtggcgactgggcaagggtttgttcgcctgaatcgccgcttttgcctcggagatagcggccatttttgcttggctcgtttggatactggcgcttagtaaccgatcaatctctttgtttttttcactagcgacggtttgggttgcctgctcagcctctgctgtcagtgtcagcactcgccgttgactcagataatcttgcacctgttgttgatagccgaatcggtctgcctttgaaaaaagatctttgttttcggtaacactttgtttcaaaacatccaattgctgctgttgctcttttagcgttgccagttgctgcttgagtaatttaatttgtgttggattagcgacatcgtggtaaacaagtaaggtctcgcctttcttcacgcgcttgccttctttcatgcggttcgagacgatccgattggcggccgtcgcctgaactgtcacggctgcctttaccggttcaatttcggcagctgtcagcacagttacctcgcgccgagcaaagatcagaaacaatagcaagcctaagaaaagaatcgtactaggcataataatcatcgttgaaaaattgcgaaagcggtgctggtaatattcggtcgttgcaagttttttgggatccatcatctaaagctcacctcactcatgaaccaggcgcgcgtaataaccgtcttgggctaacaacgttgcatggtcaccttgttccacaattttgccatgatccatcaccacaatttgttcggttttagccgcaatagttaagcgatgggcaacaaaaataatggtccgatccgtcattgccagcaagcgatcgacaatttttcgctctgtaatggtatccagactgctggtcgattcgtcaaaaatcagtacttttgccggtgacaacaaggcccgtgcaatcgccagccgctgcttctgaccgcctgataaaatactgccgctttctgacaatttggtctgccactgctgcggtaagtttgcgatgtctgcggcaatttccgcagccaaacacgcctgcgtcaaatcttgttccgaaacatccgaacggctacctaacgtcaaattcttcaacaccgtgcccgaaaaaataaacggatcctgaggtacatattcaatatattgccgtaatgttgtcaggttaatgtctttgaccggaatgccattaaacgtgatggttcctttatcggcatcaaccgggtaaaagccaactaataattttgctaatgtcgacttaccagaaccgctcatgccaacaatggtatatttagcattttccggcacttcaaggttgacgtttttcaatacatcttggccaaaaccatatttaaacgagacatcccgaacgcgtatcggaccttcgattaaatgccgctccgtcaagtgccgctgttctttgaattccgattcgaccagataaacttcattcaggcgattgttagcaacccgcgccatttgtaactttggctgtaggttgatgatgctttcaagcggattcgtaaagtatgacagcagtgcattaaaggtcagcatctgccccaagctcatccgattggcaatcaccaaacttgccccaatccacaacaccacaacgttcaacgccagcttcaacagacctttaatcgcttgctgtaattgatctgccttggtgtaactaaacgatttcttcagataggttagaaattccc

SEQ ID NO: 18 - DNA, 1717 bp, Lactobacillus rhamnosus
  misc_feature (1)...(1717): n = A,T,C or G
caagtaaagcaaggcaattgcggcgtacatgcaacatgcaccgagtcggacgtggctgttaccagacgtcggttccacaaactcgattttaactggggcaacccgttagaataaacctttatttcctaaaggaggaaattttagcatgactgttaagattggtattaatggttttggccgtatcggtcgtttggcattccgtcgtatttacgaaattgggtgcaaagagcaatgacattcaggttgttgcgatcaacgatttgaccagcccaaccatgctggctcacttgctgaagtatgattcaacccacggtactttccctggtgaagttagtgcaaccgataacggtattgtcgttgacggtaaagaataccgtgtctacgcagaaccgcaagcccagaacattccttgggttaagaacgacggcgttgactacgttcttgaatgcacaggcttctatacttctgctgaaaagtcacaagctcacttggatgcaggcgcaaagcgtgttctgatttctgccccagctggcaagattaagactatcgtttataacgttaatgatgacaccttgaatgcagacgacaagatcgtttctgcaggttcttgcacgaccaactgcttggcaccaatggcttacttcctgaaccaggaattcggcattgaagttggtaccatgaccaccgttcatgcctacacctcaactcagatgttgcttgacggcccagttcgtggcggcaacctgcgtgctgcacgttcagctgctgctaacacgattcctcacagcactggtgctgctaaggctatcggtttggttatcccagaattgaacggcaagttacagggtcatgcacagcgtgtttctgttgttgacggttccttgactgaattggtttccatcttgaagaccaagaacgttacggctgaccaagtcaacgaagctatcaagaagcacaccgaaaacaaccctagctttggctggaacgaagacgaaatcgtatcttccgatgttatcggtacgacatacggttcaatcttcgatcctactcagaccgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaagaccattaaaaggtgcttttatcagtgtcgctttggcctttgtaaacgagatgttgatggtaagcttaattgaaacatcatctttaggaaaatgaaggaggtcatatcttttggctaaattaatcgtttcagatttagacgttaaagacaaaaaagtcttgattcgcgttgacttcaacgtgccgatcaaagacggcgttatcggtgatgacaatcggatcgtggcagcattgccaaccatccaatatgtcattgatcacggcgggcaaggcaattctgctgtcttacccttggccgggttaaaaccgaagaagataagggcaaagctgacccttgaagccctgtttgcagaaacgccctttagaggaatttgcctggaaaaaagccccanttaccttnttgttaccccgacttaccccgcgggttaaaagaaatttgggaaagaaccccgcatccggcaaagtttaaaaaggacg

SEQ ID NO: 19 - DNA, 843 bp, Lactobacillus rhamnosus
agtcatggaaaaacgcgaatttaacattattgcagaaaccgggattcacgcacgtccggcaaccttgttggtacaagcagctagcaagttcaactcagatatcaacttggaatataaaggtaagagcgttaacttgaagtccatcatgggtgttatgagtttgggcgttggtcaaggtgccgatgttacaatctctgctgaaggcgctgacgaagccgatgcaatcgctgcaattacggacacaatgaaaaaggaaggcttggctgaataatggctgaacatttgaagggaatcgctgctagtgatgggatcgccacagcgaaggcctatttactggttcaacctgatttatcatttgacaaaaagacggttgatgatccttcaaaggagatcgaccggctaaagcaggcacttgatcaaagtaatgatgagttaaaggttattcgagcaaaggccgctgaatcgcttggcgaagaagaggcacaagtttttgatgcccatatgatgattttggctgatcctgactttacgggtcagatcgagtccaagatcaaagatgaaaaagtcaatgctgaacaggcattgaaagaaatttctgaattcttcattcagacttttgaaagcatgacggataatccatatatgcaggaacgtgctgccgatgttcgcgatgttaccaaacggatcatggcacatttgttaggacgtacactgccgaatcccgcattaattgacgaagaagtcattatcgtggctcacgatttgacgccttttgattctgcccaattgaacaaaaaatatgttaagggctttgtcactgacatcggccgaccgacaagggcc

SEQ ID NO: 20 - DNA, 7213 bp, Lactobacillus rhamnosus
tgattccgtttcctgtttaatcaaccagagcgtgtgcagtaaaaaaagaccgtgcttatctttcaacacagtcttttttcatctaaaggaagcttcaactagtctggttgggaatcagttgttgccaagtctgccagtgcatcaaaaaagtaagctagactcagataatcggccgtaccacccggactaagattaaacgtgatcatctcagcatttaactgacgcaaggcatgaggcaagtgtgaatccgggacatgcaacaatgttttagccgcatcttgcacgaatcgtaatccctttggcccgccgcgatggaggacattggcatcttcaacttgggccatcaagtgcaccattaatcgtaaatagcgcatatccccgcgtctggctgtcttgcgtaaatatggcaagatcacatgccggatagtcggataaccagccaaagcctcacctcgaaccccagtaacgccgtgtttgacatataacgcttcgccatggctccagcgggcttttttctccaagtcccgaaaatcaccagccacaccttgcgtcacttgagccaccgtcgggaatagcggcgcaaagtcagcggtgactatttgttgcagggattgctgctgcatgagccagcccaatgcacccaataaaaaaccaaaggagaagttagccccacgatgcgtattaacaccagcagtagcggcgagcatggcattttctgctgcaatcccaatggtgcgtaattggcgatagagatcaggaaccgttttagcaacgacgccggcatgaaaatattgctgaaaaaaaggcgtcaaagcttcaatgctagctgcaaggtcgtcacatccatatcccggtgtgcaccatttgattcagggtcgaccaagccgggtttaggcgccaactgaacttctgcttgtaaactggtaactgccgcttgtgcaattgcttgttcattcaatatgttttgccttcataactttcagaatatagtgcagggaatgctctaagtgctcgcgcgtaatgagcttaatttgatcgtcatcttgattcaacatcccccgataaagcagccaatgttcctgaatggcaagattgcgccgatcatcgccattaatactgatgtcacgaaaataaatcaaataattctgcagctggttgacgatcattttcagccgcaacatatgactggcatcataaataaaattattaaattcagtaaacttagccatcacctcggcaacacgaccggctgcgttcaaacgatccgtttcttccaaaagagtccgcatctgattgaattgctcaggggtcatcagacgcatggccttacgcgtggccaacacatccaattccttgcgaatgtcaaaaatttcataggcatcgttaattgaaatacctttgacaagtacaccaacacccgttttgcgttcaaccagatcttcttcatccaaacgctcaagtgcatagcgaattggcgttctgctgatatttagattttcggaaagattcttctcgttaatccgctcaccgctgggtatttcgcccaaaaggatcgtcttacgcagcgcttcgtaaatcgcttctttaattggccggttctgtgacaaatccaaatttttcttaaccgctgacaccacttgattcatcgattgtcccccctcacctaacccaatattataccttaacgtgtctcaccacttaaaacatgctggctcacgctcacttaaaaagctgccgacaaatttgtcaacagctcaaattgtgctagcctaccaactcacggccgcgcgttaattgattagggggcgaaaggatcatgtaccttaattatgagtaggatcaaacgtcagcgaaaccttttgaaccggcacatcataaaacggatcttcacgccggcctaaaaagtcttttgcctgatcagggaagagcgcataactcaagacatcttcttctgaatgagcatactcggcaatagctttgcgaaatgccggtagttgcggctcaatcaggtctgccggtcgcgtggtgatgactggtgcgtcaccaataattttctttttcatctcaggagaaatcgggacaggcggctgcccataaagtccgcgaacatagtctttgatttctttagggatcagtttataccgttctccgctcatcacattcatcaaactttgcgtaccaaccatttgcgacaatggggtaaccaacggcggataacccaagtcagcccgaacgcggggcacttcttttaaaacatccccatataaagcctcttgtccctgatctttcaattgcgccaacaggttagaaagcatcccgcctggcacttggtaaatcagtgactttggctcaacatctttaacgcgggggtttagctgcccggcatcccggaatcgatcgcgaatcggcgcaaaatagctggcaatgtcactgacttcagctagtttgacatcagtcgggtagcctaagtcctgcaatgccacgagcattgattcggttgccggctgactggtaccgccagcaaatggggaaaccgccgtatcaataatatcagctcctgcgcgcaccgcctcaagatacgtcatttcagccattcccgcagtcgcatgcgtatggacctctagtggaaccgtaatttcctgcttaatgccgcttacaagatcgaaggctttctgcggggttaaaatgccggccatgtctttaatggcaatggagtcagcgcccatgtctgccatttcttttgccagcctgatgaaatagtcaatcgtatggaaatcactggtggtataactaatcgccagttgtgcgtgcccacccgcctgcttggtagcttccagtgcggttttcaaattacgtgtatcatttaacgcatcaaaaatacgaatgatatcaataccgttttcaactgatttcgtgacaaaatcggctacgacatcatcagcataattcttataaccaagcaagttctggccacgcagcaacatctgcaacttggtgtgcttgactgcttggcgaattttccgcagtcgctcccacgggtcttcgtttaaatagcgtagacaagcatcaaacgtagcgccaccccacatctccaatgcgtggtagccggccgcgtccattttatccaaaataggcaaaatatcacttgatggcatccgggtagcgatcaggctttgctgaccatcacgcaaaactgtttccatgaattggactttttgtttagccatgtgtggtccaaccctcctttatgattgcttcaactgccgcttgaacttcaggcaatccgtgtcgacgtgagcgcgcgcaggctttggcgtctccgccacaaaccaagcaggctcgcggaggtaacttaaaatcggtgcgcgaaacctgatgcagttcttcaccttgcaacgtgaccacatccaagtccagtaagtcacaaaagcgttgttgctgctcaaatccgatcattcggcgctttaaactaaccgggtccatgtgcaccgccaagtaagcttcagggccagttggtaacgattcgatttgcatgccttgcacgtttggttgtaattgatcctgcaaggcttgcatcgcagctgtaaacactgtaacgacgcgttttccggttttgaccggtcccggaatccgcaacgtcacgtgtaatagcgtcgtgtccggatttgcctttaaccagtcatactccttggtcatacgcgcatctttggcggccaacatttgccctaagtcaacttgggggccatccaaaactgacaatttaaacattgtgcaccacatcgattaaggtaccatcacgatattcaatcaaagcaaccaccttgtcgccatactgaatagctgcaggcgtgcccgtgatctgataggccatgttcttgagtgcttcaatcgaaaattgtggcaccttcaaatccttaaacatttcaatcagatctggccgggccgggttaatggccacgcccacttccgtcacaacaacatcaacactggctcctggggtcacaacggtattcacattttcgacaatcgttgggatgcgtccacgaaccagcggcgcaatgaccatgctcattttgcaggcggcacttgtgtcactgtggccaccggatgcgccacggatcacgccatcggaaccggtaatcacattgacgttaaagtccgtgtcgatttccaacgctgacaaaatagcgatatcaagctgattaatgaccgcgcctttgctcaacggtgacgcgtacatgttagcatcaatttcatagtgatcggcattttcaccaagcgagactgcagatgggtgatcgaagtcctgcacgtcgatcactttttcaacgagcccctctttcaacaattcaaccatggagttggtaatcccgcccaaggcaaaacttgctttgatattttgctgcagcatcgcctcacgcaagaagcgggctacggccaacgaagagccgcctgtaccggtttggaaggaaaagccatccttgaaataagcagatttcgtgatcacttcagctgcatattcggcaatctttaattccttagggttcttcgtaaagcgggtggcacctttagcaataccggtcgggtcgccaatcgcatctacttgaaccacatagtcgacatctgtttggggaatactgatcggcgtgttgggatatggcattaggctgtcggtaatggcaaccacttgatcggcatacttggcatcaatcatggcatagcctaaggaaccgcaagtcgctttgcctttggtaccgttaatattaccgtattcatcactacttggtgcgcccaagaacgccacatcgatatgaatatcgccacgagcaatagcgcgagcccgtccgccgtgagaacgaatgacaaccgggttttgcatgattccgcttgaaatagccgcgccaactttatcccgcaaaccggagctggtgatgttggtaaccacaccatttttaatgtgttcaatcagcggttcatgaacattggcaattgaactaggggcgatcgacaggtttttgattcccattttggcaatttcagccagtaccatattcatcacatagtcaccttcgcggaaatgatggtgaaatgaaatggtcattccgtcttttaggccggttgcgacaatggcatcatgaattgacgccactagtttactgtgatcaggcttgacgggtttaatgtggcgcgcatgttcatcataaggttgaatattggcaaactcgccaccgaaaacgccatattgatcggcaaacggctccgggatttcacgattaagcttattcttgaccatcagtctacctccattcctgacgccttagcgagcgcaatcgtgtattgagcacgctctaccactggcttgtcaaccatctgaccattgaccgaaaccacgccggcgcctttagcttctgcttcttttagtccggcaacaatttcccgagccttttgaacctcagccaaagcaggcgcaaacacgctgttgatgaccggaatctgccgcggattaatcacggatttgccatcaaagccgagttgcttaatcagctcggtttcatgacgcagaccttcttcgttgtccacctgcgtgtaaaccgtgtcgattgcagaaatgccggcttcacgggcagcatgcaaaataaagttgcgggcaaatgacaattcggcaccatcagcggaacgatgggtatgctgactggttagatagtcttcggcgccaagtgcaatcccgatcattcgtggggatgcctgggcaatttcccgggcattcaataccccttctgccgattcgatggcggccatcatatgggtcgtgccgtttttgataccgtactttgcttcaactgccgtaatgaccgcatccacgtccatgatgtcctgtgccgtttcggtttttggcagccgaattacattgataccgccaagcaccattgcctcaacatcctgatcgccgcctgcatccaaggcattcacccggacaacggtttcaacactgctgtaatcaaaagttttcaatgcagaatagaccagcattcgcgcggtatctttttcttttaacgaaaccgcatcttcaaggtcaaacatgatggcatctgccccataaatcggcgcatcacgaagcatgcccggattagcgcccggaacaaacatcatggttcttcttaatttatccatgcgttaatctcctcccagtcaaatgtcttgttgtcagcagcgcggtaagccgccgcaatggtgcgtgctttgatcgtacaatccagtgcacctttgtcattggcttcaaccgcaacgttttcgatcgccagttttgcaagtgttgctttgatgaccgcacgaatttgttcgccaaattgcttttcaacactgctttgcaactgaatcgtgataccgtcagcggctggtgcaagcgtgatttgaatatcacttgactccagtgtcccagccgtaccgggatgattaattttcatgggttgatcgctcctttatttctgtataaacctctggataaacgagttgttgcaccgttttccaatcctgttgtgcaatcgccgcccgaacccgcgtggcactaacaacttcgccagcaatctgcaagcgcggaacaacaatcaattcgatggtgtcaccaaaagtggcggctaattggcgattgtaaatagcggtcacgggtgacaatggctcttcaccgacataacgccgggtaatgtctaaaatgggggcaattcgctgtttaaaaagcgccgcatccaattcggcttggaccgacgaaatggcccgtatcgcctgtaccttggaaaataactcggaaacgtggtattcgacaccatgtaatcagcggttggcaacaccacgacattcgcccagcgtgaggcgattttttttacgaggcccaagcgttcggcagcggtgaaaagcgagcgttcggctgacagcacaaagacgtaaaccacggcattgtccctagctgcctgctcaatcagatacgcatgaccgcgggtaaccggattggcgttcatcacaattgccgcaaccggctgtcctgagtgctgatgctgctccaacaatgccgtgtagtcagcaaaattaggataaccacgttcgagcaaaaccaccgtgtctgttgccactaactgcttaaagcctaacgattcaaaaaactttttcgtgcttggcttggtatagacaaaactatgcgtaatcgtctcatcatccagcc

SEQ ID NO: 21 - DNA, 6240 bp, Lactobacillus rhamnosus
aggcagccactgattcatattttgtaaatatcggacattttccgccgttacgccaaagtatggtgggaactggcacaaaaccgcgtgtaattgatgcgtggcagtcaacggcgccaccatgtcgttgaagcgcgaaaattcggccaccaggtcttgcgttgcggcgtgtttcgtcatcaatttgcttgctttgattataaactgaaagccggccggcacctgcgcctgccaccgtcgcactagatcagcggttttcaacccataaaacgtggtatccagttcaatgaccggaaaatactgggcgtaatcagcaaacgtactgcgcttaccattggccgccaagctagggtgatcggccacgctggttaatccgaccctaatcatggaactcaccatccgcaattcgaaatgcctgaagcgtgtcgccgttaaagtaggaagcataatcatgtttttcgccattcaacgcatatttcaacaacggctgcagatccggcaccaacccgggattatccgccagcagccacgttttggaaaaggtcgctaaaataccttcccgcgtcgctcgcggtcctaaaaacggctcatcggttttcccgaaaaaggcgtaaagctcaccccgtaattggccatcaacatgccaaaaaacgcgcccaacgcccgttaactcatgagcagggatgataatgtggctttcctcctgtaactcccgtgctgcacaaacagcaggtgtttcatcaggcaggaacttaccacccaacgtattccacatcccgcgatacggtggattcgtccggttgattaacaaccaaccacttggcgtttcaacagtcaccaacgtatattttttaaccatacccgaaaaactccttattaaggcgtaacattcaaattaactctagtaaaaaggcgccgatttgatcagcaccctcaacgttggagtaaaacgttagagaataccggtcacaatttggcgtctttttatgcatgacatcaatgctactggattaatcttacttcatcttttccactgtagctttaatgatgcccgcggaatgaacatacttagcacgctcttcatcggtaagcttcaacttaggcgtgttaacaacaccgagcttgccaatcgtcgccggatgaccgatggcgataccgaattcaggatcatagttagcgcacggaaaaatccgcttggcatcactgataatcgcctgtgtcatttcagtagcaatggtggcaataccgtagctggtataatgtttggcctgataaatcttccagccgccagcccgcgccgcatcagctaattgatcataatctacttgcgcataatccgtgattggctcgttgttaacccgcaccgttgaccacgccgtaaattgtgactcaccatgctcacccatgttataaccgcgaacatcggcgacattcacatttagcgattcagcaaccgcgcgccgcatccgataagtatccagcgaggtgccggtgccaataatctgggactttggtaggtcaagtaaatattgccaatagctggtgacagcatcacaaggattggtgatatccagcaaaacgccatggaatccggacgctttcaactttggtgccacatcgtctaatgcttgttttgacgtttgggtttcaccaattcgatcgccgtttgaaatcgcaccgatattgccaaccgcggaaatgacaacatctgcatctttcaaagcatcgtaatcattgacgataatctcggtataagtcggcaatccaccaagtgcatccttcaaatcataactttcgccttcagctaaatcagccttttggtcaattagcaccagacgatccgcaatccccttgctaacgagattaaatgctgttgtcaccccaacatgtccaataccgataataccaatggttcttgccaagataaaaaccccttttcacaaagtttagtttttcgggccatgtagcaaatgccgttcaacccgctgatccgggatggcccacaagagtaacattaccaagtccagtatgatcgttaacggtggccaaagcaaagccaaaatcatggcaacaaatgcgatgatgatcgaaccgattgctttccagttatgctggcgattgtataaagcagccagttcagagtgtggtccattaactcgccgcaatgtttctaccaacaatagataactaatattggccattaaaaccacaaaaccatagatcaattccggtccaaacgcatcaacatgcccttcgccaacccagctggtagcaaaaggaaacattgaaatagctaacataaatagcgagttggcccacatcacccgccaattgatgcgcttaaccaactgaaaaaggtgatgatgattgttccagtacaccatcaacgttaaaaacgagaccaggtaaataccaaacacgccgcgaagttcccaaagcgaagccagtgagccgctgtggggcggatttaattccaacaccaaaatcgtcaaaataatggcaatcacagcatcggtaaatgcttctagccgtcctttgttcacaagccattccccttttcgtgcaccttgtaaatgatcagacgtgcaaatcggcaaaaatatcggtggcatctcccagtaccatgtggccaccttgaggcaaggcaatctgctcccgattaacggccacaatcgtcgcatccggttgcgcatacccgatgagtccggcaaatggataaaccacaaaactggtgccaacgacaattaataagtcagccgaagcaatcgcattaatggcggcactgaccgtatccgggttgattggttcgccatataacacaatatccggccgtaaaataccaccatctgctgcgtgcacgtcgcttttcaaataagtctgataatcaaaatgttggtgacactgctgacaataaatgcggtacagattaccgtgaaactcgaccacatgcttggctcctgcttggcggtcaagtccatcaacgttttgcgtgacaatggcgcccttttgattactaatcgccgccattttttcatgaatcacattgggtttggcatcagggtaatacatgttgttcacgacgaattcatgaaaatcttcatgatgtgcctgcagattatcaatggaaagcgcgtactcgggatcaaccttatcagcatacaggccaccctttgagcgataatccggaatccccgaagccgttgacacccctgctccggtcataaacgtcacatacttagcctgagtcactgccgtctgtaaatcaaacattagccatccctccgtcgttatctcttcctatcaccaatatagcaagcatcccaaccagtattatttaattgccgtcaacgtttccccttgacaagtcgtttcaagtccatgacagcgcattcagccgtcaaaaataattttgtatttcttaacattctacggtcgaaaggtgtaatattattctatataaagattgatagaaaggagtcttgattgtcatgaaatcctttcggtggtcgcacttctttagttatttgattatggccattgttttagttttctttgccattgttctttaccaggtagtcatgcttggtattcaatccgtcactaacggcttctttattaatttcggtcatcattaacggattgtataatccagttggtactgcgccagaacgtcattcagcggttgttgatacagctgctggaaggcttctggcgttgttgcgttctcggacagcggcaagacgaatgcattttggtcatcacttcgacccatggcaacataagcaggctgcttagtctcccgatcgcggtagccactgtgcttgattaggtaaacctgatccaaggtgagtcgcaattgccgtttggataaaaccggtgacaacgtagcgaattcctgatcgtttgtgggttgatagcctagttgctcaatcaaggtatcaaagcggctaaacaaatgcacgatggcacggcgcaatccaaacggcgaatcgagtttctgctcgttaatcaactgaaaaagttcttgagcgtaaggcaatgcttgcgggtaggcagctgccaaatcagcgggcagcttgccatctaaaaagcctaacaggtcaagtaacgataaaattcggtagatgaccaattgatcgtcagcttcagcaggtacattttgcttgaatccggctaacacttgcgccacgactgcatccgtgattaacccgtgttcgcgttgccatgccaccaccaacatatgcaccgcagcgttatacaaagcggtactggtggcgtaaagctgatcatcgacttgaggatcaccgcttagcaaatgaaattgcaactgcgaatagcctttcatctgatacaacaagtgaagtaattcgtgactcagcgtgtaatccgcattcgttgtatccgtcaccactacctctagcgtaccatcttttttcaatcgctgatggctctggtcgtgagtcaagaccccacttgcctcgccttgaatgaccacttctaacggatgatcatagtgttgtttaacctcgtcaagtaatacctgaacattttcttgcatgccaataattctccttttgcctgcgtgatcggaatattgagccaattaagcagtcatttttccggtaacgattggctttcatgtttttgatccactatcattaaggtagcgataaaaaggaggaaattcaaatgaaactatccgtaccacttgttaacggccagcttgatgatcgttatggcaaacatgctaccggtgctgatgttaaaaacggttacccgattacgagttttccgtttacgattgaagatgcccctgcaggtaccgtcagttttgccctttggttcctcgactatgatgccgttccggttggcggcctgccgtggattcactggaacgcagccaatattccggcatcggtcactaagattcctgctggtgccagtcatcacgacctcgtgccgatgattgaaggtaaaaacgccacggccggtcatttggtgggtaacacggatccatttacccgggaaggctatgttggcccgcaaccacctgacaaggatcacgattacacgttgatagttttcgcgttagatactaagttaccactgcaaccgggtttctggttaaatgaagcccgccatgccatgaaaggtcatattttagcccaggcagaagttgacctcccatcacgggtttaagtgcgggggttgctaaaaagtaagttactcaaaaagcctgctgatcagtttcagcaggctttttgagtttagctcaacttcgtaactttacagtccaatccctcaaccgccatcgccggtgttcatccacaatgctccggcaccgaccgcggctaccaggccaatgccgataataccgaccaaggcaaatttgaaaattgcaaaaccgccgagtgcaaacagcgccagactaataaacgggtgccgcaaaatcgcaccgaggagtttaacaaccaagaacaggataataatgacggcaacaatagcgccaatcgtgatggcacctgttagcgtgtgtccgttttcgctctgtgtacttgccagcatacttggtaacatcatgaaacctcacctctcttaatggccaatcccacgcagctgtccgatttgactaaaacatgctgcgaacccactggacaatgccactaaagaagctaacgatgccgtcccagattttctgtaggaaattacgattttcctgcgtattcaaactactattaagcttgtcgaataagcctttagctgaattttgaattgaatctgccagtttgccagcctgcgctttaaaatcggtattcttcaaggaaccggccttttggacattcactagcaagttaatgattaattgccgctgattgttattaataatcgtggtcagattattctgtttcagctgactgtcaacgatattgccaatttggttctgcgacagggtttgctgcccattgttactttgcgaagccatttgctgtttggctccggcaactgcattgttcagctgtttgtcggtatagccatctttgcctttattagcctgcgtgatcgaactcagcgtattgacttcctgctgggcggcattaatctgttggttattcaggttctcgccattttgggcaaacgctgcataaacccccgctaacgcaccggaaccatcgattttgaccgcactggtgatgtataaattagcattgctgaccccggccgttaatgcggcgtttcggtatt

SEQ ID NO: 22 - DNA, 3193 bp, Lactobacillus rhamnosus
tcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatcatccttgccggcgcgatgcagcagctgccggtcaatatgcttggtggctttgcagtgattctgacgatgggctggttgttagggacaattggtgccaacattccggtggttaagaatttcggcgggccagccatactgtcgttgttagtcccatcgatccttgtgttttataacgccctgaatccgaatgtgttaaaagcaactgacatgttgatgaagcaagcaaactttctttatttctatattgcatgtctagtctgtgggagcattttggggatgaaccgcaagatcctgattcaagggttgatgcggatgattattcccatgatgcttggcatgattctggcgatgggtgtgggtactttggttggcgtgttattgggtctggagtggaagcatacgttgttcttcatcgtgacgccggttttggctggcggcatcggggaaggcatcttgccgctgtctctaggatacagcacgatcacagggacgaccagcggcgcgcttgtggctcagttaattccggcaacgattatcggtaacttctttgccattatgtgttcaggtttattgaatcggttgggagagaaacgtccggagttatccggggcagggacagttggttcgactgaatggggcagaagatgacttggcagacgcgttgaaagaccattcggggaccgcttgatctaaaaatgatgggcgcaggcgttttcaccgcatgtaccttgttcattatagggatgttgttgcaatcagtgcccggatttccagggcccgttttgatgattgttgccgcggcgattctgaaatatgtcaatgtcattccgggtgaaacccaccgaggtgccaaacagttatacaagtttatttccagtaattttacgtttccgttgatggcgggactgggtttactatacattccgctaaaagatgttgttggcatgttgagttggcaatattttatcgtggttatcagtgtggtgctcactgtggtttccaccggtttcttcgtagcgcggttcctgaacattaatccggttgaaacggctattgtgacggcttgtcagagtgggatgggcggtactggcgacgtggctattctcagtacggcgaatcggatgaatctgatgccatttgctcaggtggcaacacgcttgggtggcgcgattaccgttattaccatgacggcgattctgcggatgatcttttaaatcgactagtttcgaaacttaaggaggatgattcacatggcaaagaaggattttaatcaactagcgctagatcaagcaaaagtaaatggcggaaaattgagtgtggaaccgaaagtaccaattgagacgcgcgatgatttgagtattgcgtatactccaggcgtcggggcagtttcttctgctattgccaaggatcagtcgctcgtttatgacttaaccactaagaaaaatacggttgcagttgtcagtgacggttcggcggttttagggttaggcaatatcggtgccgaggctgcgatgccggtgatggaaggaaaagccgctttgttcaaacggtttgctaaggttgatgccgtgccgattgtgttggatacgcaagacactgaagcaatcattgcggcggttaaagccattgcaccaacatttggcgggatcaatcttgaggatatcagtgcgccacgatgttttgaaatcgaagcacgactcattgatgagctcaacatcccgggtgttccacgatgatcaacatggcactgcgattgtggtgctcgccgctttgtacaatgccttgaaagtagcggataaaaagattgaagacattcgcgtggtggttaatggcgggcggctcagcggggctatccgttgcccggcgattcttggcagccggagtcaaacacgtcatggtggtggataaggtgggcattttagctaaaaagaacgctgatcaactgccaccacatcatgcggcgattgctaagataacgaatcgggaaaaccgcaccgggacgttagaagatgccttgaaaggtgcggacgtctttgttggggtatcggcgccgcacgttcttaatccagcgtggatcaaaaccatggcacctaaaccgattattttcgccatggccaatccggagccggaaatttttccggatgaagcgttggcggctggcgcatatattgtcggaaccgggcgcagtgattttgctaaccagatcaacaatgtgctcgctttcccaggcatcttccgcggcgctctggatgctagggcacgcaaaattacgatcgacatgcagattgccgcggctaaagggattgccagtttgataccggatgatgaattgtcaaccacgaacatcattgccaatgcgtttgacggggatgttgccgaagtggtagcagaaagcgttcggaacgcggcaaaagcaacagcgaaagcctagaaatcaatttagaagcctccttacaagatcggtgacgattgcgtacgggggctttttgcttggcgttatctataagaattaagacagatacacgtagattaggtgaaaaaggaatttgtcgcgtaactttagctgaaatgaacgttaaatgccgaaatccctacgtttaaatgttgttggatcatcaagcgggattgccttggggtcaaacggcttgcctgtatcacgggtgacgaaatgacttgctgctgccaagatgttgaggttttttaaacctaaaaagtacatcttcaacaatccgagtgcttccacatcgtctttgggaacctgagtctgttcgagtccatcgccactaggctggagcgcgacggtatcagtcaatggttcttctgacaaaacaatcccagccgcatgggttgaataatggcgcggcaacccttccaaagccaaagccgtttgaaaagcattcgattttttggcgaatccgcaaccagaatttttaatggctggcctctgttcgtatgcaggtttcaaaatacatatgaaataagttaggaatggctttacttcaaggatttgttttaaaattgacttaaggccaaaacccggcgcgaa

SEQ ID NO: 23 - DNA, 4159 bp, Lactobacillus rhamnosus
atagttaacctttcatggtccgtttgctactactttcatcggtccatggcacagtttcatcagcttcattcggggaatagtgactgataacatcgcgatagaaatcaagtacccgatcgccaaaccgatcagcagaaattgccgccagcttttcagttcgcggtttgggatcatcataggcattaggatgcttcagataattcacaacttgatgaaccatttctgcttcagtcgtaaaagttgttcccaacgccggatcatccaacagttgatcagtataatcaccagcaagggcaacaacttttccgatcagcggccattgcctcaatataagtcagtccctgtgactctgaatcactagccgacacaaaaacatcgccgacacgataatagtcgcctacatcatcatggtcaatttcaccggtaaaccggacatgatcggcaatccctaattcagcagcctgtgcctctagatcttcacgtgcagggccatcaccgacaattaggagaactgctttaggaatttgcgccaaaattgcgggcatggcgctgattaatttatcaattcgcttttcataagcaacgcgactaagcgaaaccaataccggcacatctgccagtcccagcttttcccgtaagtgcgggtccttttgctctgcgaattgcgttaaatcgactccggttggaataatcttaatgtcggtcttaacgccataacgccgcaacgtatcatacacccgctcagacggcgcaatcacaccgcttacgtgatacagaaaagcgcgggtaaattgtttgacatggtacggctttagcagatgaccgtttaagacataatgcagataatcctcatacatggtgtgataagtatggatcgttggaattttcagttgtttggccacaaacttaccaatgtaacccattgagaactcagtttgtgtatgcacaatatccagatttaattccttagccactgcataagcgtgaaacagcccccgaaccgcaatacgccgatcagtaaaagaaacaaacggcacacttgtaaatcggaacaagttcggttcgaccgcatcatctggcacatgtgggtcggttgtcgtgaaaatataaacctgatgacccttacgttctagatcgtccttcaaggtcttgatggacgtcgcgacaccactgacttgcggaaaatagctgtctgtaaaaatcccgatattcacctgatcccctccagacgtcatttgtttagtataagtataaagataggcatggctaaatgcaattttctcacaaacctttaaaattatcttaccttgccatcagatgaacatcatccggcaaaagtcgtaaatttttaagcagccgcttgcgaaacatcccgacaatcagtcatttacaacctatcttttttgaagaaatatctattaattcatttatgaatacatattaacatcttcacttttggggttacttgtcacgctcgatgtcttccgctgcaggcattttaactttatcgttaacacgcgcggccttacggaagtacttcgatatgatatgactgttgatcccccagaaatagaagaccaccgcgccaagtataatgacgacaaagtccattggataatggatccagttcaacccattaaactcagcactgccaatcagcgaaattaccgagagaaaaaccaggtaaccaagcatccacgccgaggcttttaactgctgccaggtactgcgccaacctgatcgccattcataaaacagatacaacggaatccctaagaagataaccccaatgacttcaacggtggttggccattttgcccagtaagccgctaatgatgtcaacacaaatgccaacggtgccattactcgcaacatcgctgatttgaccggacgcttgaaattaggcgccatttcacgcaaagagatcaccgtgaccggtcctgtcagataagcaattaacgtagccgttgaaataacactggcaagcgtcccccacgatgggaaaatagagaccataatcatacttaagacagcattgaccaccatcgcgacacgcggagttccgtacttttcgtcaattttaccgataaacttaggaatgtgattgttgcccaccatcgcctgaagcgcacgaccggacgaggcgacaaacgaaacgccagttccaaatggcgaaacaaacgcatccatatatagcaaaaccgacagccagtgaataccaagcaaaattgccaaatccgcaaacggcgagttaaggttcaggcctttccaaccatgagcagcaagcatatcgggagaaatggtcgtgataaagacactttgcagcagaatataaataattccgctaatgagcaaagaaatcccgatgccgcgaccaatattcttttgcgggcgtttcacatcgcttcccatattaataacagtctggaaagcgttaaaagaaaagataatccctgaaaccgaagtcgccgcaaaaatcggtgcactaccataaggcatcaaggttgacaacgaatgcccataattttcggggtgaaaactcgacaaggccagcaaaacgatccgaatgccaagaatcgggttgtttttaacgaaatcaccaaagatgccgtaaaaaatgcatttaaaacccctcgtggtattgatatggatcttgtcgatgcgcaacaagcacgccgaattctcgatcggctcgtggggtactcgatcagcccgctgttgtggaagaaggtcaaaaagggcctgagtgccggtcgggttcaaagtgttgcgttaaagctcatcattgaccgtgaaaatgaaatcaagaactttattcctgaagaatattggtccttggatgccgaattccaaaaaggccgcagcaagaaattctccgccagtttttatggcatcaaaaacaagaaaatggcgctgaagaacaatgaggcggttcaaaaagtcttaagtcagattgacaagacgaagccgttttccgttaccaatgtggttaaaaaagaacgcaaacgtttccctgcaccgccatttaccaccagtaccttgcaacaggaagccaaccgtaagctaggattccgcactcgtaagaccatgatgttagcccagcagctctatgaagggattaacttaggcggcaagttgggtacggttgggctcattacgtatatgcgtactgattcaacccgggtttccaacgttgccaaaaccgaaacgagtcattatttgcatgaaaaatatggcgaggcttatgccgctgtcaaaattcgccaaggtaagcttcaagaaggggctcaggatgcccacgaagccatccggccgacgagtacgttacgaacaccggaaagcttggcgtcggttttagacaaagatcagatgaaactgtaccgtttgatctggagtcgctttgttgctagcgaaatgacgccggcgattattgacacagtcgccgtcacgctcaatcaaaatgacgtgacgttccgggcaaatggcagccaaatgaagtttgaaggctttaccaagctatacgtttcctcgcgtgatagcgatgaaaaggataacgttttaccaccgcttgcagtcggcgatgctgtgaagatgctgaaaaccgatccggcgcaacactttacccaaccaccggcacgttattctgaagccaacttggttaaggctctggaagaaaacggggttggccgcccatcgacgtatgcaccgaccatcgaaaccattcagaagcgctattacgtcaaactcaacgcccgccgctttgagcccacggaattaggcgaaatcgtcaatagtttgatcaggcgtctcgggataaggaaactcatcttcaaatttttgctgcagatcatcatccggcccgaaagcataacctttttccgcttcccgtttggcgtacaagtcaatcagctcgtcggcaatgtcttcgattcgagccgccactttgcgtttggtcttttgccactcggtaccgccaagcttattgacgttaggcgttttgccatctgcagaaacgtatttctgaaccagatttaattggtcaaccggaataaacagtttgtcattgttgcggtaaacgatggtgatgtaatcgcgatggacaccgtcaacttcaagcgtctccatgccggtatattgcccaatcccgtggttgacatgg

SEQ ID NO: 24 - DNA, 4784 bp, Lactobacillus rhamnosus
aacgaagccaatgctgactcccgctctggcaagaccattaaaccggttttgattattgataaagactatgtaccgggtaagtaattgatcttttcccttggccctagctgtggtttgaattcaagcacaaaataataaagcaccaggaactccaacgctgagtttcctggtgctttattgtgttcagtcttccttgttttattaatctctggctttaagcggaacctcattgatcgaaactcgctcataatgagtcacaccatagcgcgtattataagtcaggcgcagtatttgtccgtcagagaaggggccgggatcatactcatccgtcttaaactcaagtagcttcccgcgcccagcagcatctttcgccaacgctcgataaacgtaacatttttggcgcagattaaccggaactgtcaccgaaaattggctgcgtggttcatgtacttttgcataataggcgacaccaccatctctgtacaccgtccaccaaagcgtaagcgcaataaccaccgccaatgcactcacaaagccaactttataaagtgtctcctctgtttcaatcgttaatcttctcaccccgagcatttcctttctgttttcaaaaagcaccttgatcaagttgaaagaaactgttcattgctatttaacaagtttgaaaataagcaacttgactgcgaattatctctagtattcagtcctggcgctccttaggtcaaagtaccaaaggaagttgtgtcggtaaattattcggttgtttttttaagagatttcttacacttataacaatatatgttattaatttggatggtatgttttatccggatttctgatgttagtaaaacattttttcaatatgactgattatgtgaggcttgaaagtatggtgactcccaacgtattaaaacatcactccgcagccgatgcctgaacatactcattcataatcgccgcgtcggcctttgtctccacattacccgcatagttcggtgtcaccaatgagacggtgccgtgtgcgttgtaaaacagataaaacttatctccaatcatgttcgctgcggtttgcgaatggctcccttcatcggtgaacgatcccactttaatctcggtgttgcatttgacggtccgcgtttggcctgcagcgtcagcactgaagaccttgattgttttagttgcaacattgcggatggtcgctttcatcgtgacggcatccgcatgttgatactgaatggtcaggcgataatttgctgtctgcgggtccgcttgcaactcaatccgagtcggcgcattcacgccttgtcgtgtaaaaaccgcccctgaacgttcccgcaaaagcttggcaacatcaacaacataatcttgactaccagctgttgactgagaactgcgcccccgactttcccccatatcacttggcttgaccgcactgcttttacttgcatgctgctttgaggtcacctttttgatcgcgctttgttgcgattcagtcagtccacgctttgtttgttgttgggcaatataaaaatagccgccgataatgaccaaccccaggatcaaaactgctaacggcgccatccactttctcttaggtggtcgttgacgccgtctgctttcactagtctgtttcaagtttaaaaacctcacttaattgttggcgttacgctgccttatcgactttgttagctcatagaaaaagtataacatggcgctttttaaacattatagttcggctcgtcagtacgcttggcaaaacaactaaacctttacagcatttttactgcacatatggtttgaaactttatactgaaactaatgatcatcgtctgtttgtctgcgcaaaaatcagtgtgttaggagcttggctgcagtgcactggttctcaccacgatgctcagattcaggcccatgctcactcacaaggaggttcttttcccatgcacaaaagttggtggcaagaagcagtggtttatcaggtttacccccgcagttttcaagatagtaacggcgatggtatcggtgatttgcaaggtatcatccagcatttggattacattaaagaactcggcgctgatgttatctggctcaacccgatttacaaatcacccaacgccgacaacggatacgacattgcggattatcaacaaatcatgccggagtttggtaccatgaccgatttccaacaactgttaaaagcagcccacgcccgcggtttgaaaatgatgatggatctggtcgtcaaccatacctctgacgaacatccttggttccaggcggctaaacaaagtcgcacggatccccatcatgactggtatatttggcgcgatcccgtcgatggtcatgaaccgactaattggcgcgcggattttggcggctccgcttggacgtatgtaccggaagtcggccagtattatctgcacctttttgcggtcaaacagcctgatctgaattggaccaatcctgctgtgcgcaaggccgtttttgacatgatgacgtggtggtgtgatcaaaggattgatggctttcgaatggatgttatcaatctgatttcaaagcctgatgtttttgctgatgatccacaccttttggaacagccaaacggtaactcgctgggcttaattgccaatggtccgcacgtgcacgaatacttacgtgcgatgaacaaggcggttttgtccaagcacgatcttatgacagttggcgaggcacccggcgttacgcccgccttggcacttcaatatactggtttcgatcgccacgagcttgaaatggtcttccagtttaaacatgttggccttgataacgatccacaattcggcaagtggtcactcaaacatcctcagttgaccgatctaaaacgcgtcctatccgattggcaaactgcactacacggtaaggcttggaacagtttgtattgggataaccacgatcaagcccgcgctgtttcgcgttttggggacgatcgccctgcttttcgggttcactctgccaaaatgctcgccgccactttgcattttctggaagggacgccttacatttatcaaggtgaagaacttggcatgaccaacgttgccttcccatccattcacgattaccgcgacctcgacaccctaaacgcttggcatgaacttgttgaacagcaacatgctcttgcgccagaagatatgttaaaaagaatccaccgtcgttcccgtgataacgcccggaccccgatgcaatggtcacctgcaccgcaagccggcttcaccgcaggcactccttggctagccgtgaacccaaactacacggacattaacgcaaccgctgcactggcagattccgattcggtcttcttcttttatcaaaaactcattcggctgcgtaaacaataccctgatctgattgtttacggcgcttacaccttactcgacccagacgatcctgatgtatacatgtaccagcgccacgccgccaaacaagaactgctcgtcatcagcaacttcaccgaccagacgttgactcgcgatatcgccaaacagctgtcaccttcagccaagctactcatcagcaactatgacgacgacgctgaaaatacgctccggccttatgaaactaaagcgtatttgaccagtgagcgatagtgagttcacttttgatctttaaaaaacgcaacgaatctcattcggaggttgtcaaaatcccgtcctcaccgatttttcttcatgtagaacgcgtctacttgccattacgtaacgatgcggccacatcaagataatcatcgtgatggcatcggttgattcgattctcttttaacggccgtcagccaacttgctactggttatcactagcttcaccgccaattagcaatagttgctggccgttatcggggacgcctcaatcgcgctttacccgtttcttctcccccgggggttctttatgcaacagtgctgttgcgttacataacataaatcattaaaagagaaacgcaaaatagttgccgcagttctatccgcaggcgccctacaaatgccaaaccagtcatggatatcatcggtgccagtggctgatcaagcgaaaggccaacaatgaaaggctatttagcatgccatcatgctttcaccttggatgaataatacaaataccatatcaccgtcacaatttcgtcacatctgctctgtagtattagcaacatagaaatgagccacccactcattcctatacaaaccccaacccaactttttcatttttactcctccaaagtagaaatcgtcagccggcctcccaccggctgaccaatacataaataaacccccgcagtgtgaggtgaagtgccccataattgttagacagatactctaatgattgtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagttggccgtggtagactattatcaaaccagtggtgaaggtgtggcatcggtagctgctcatttcgggatcaacgcttcgcaggtgactgtttgggcaaagatctttaggactgaaggagtggctgggttgcgtccgaaaccgcgaggaaggcggtctacagtgaaacataagaaacccaaacaagttaagaagcttgagcttagtgaaaaggaagcttaccagcaaga

SEQ ID NO: 25 - DNA, 4351 bp, Lactobacillus rhamnosus
ggtgccattttaagcccgcttgactgtagcctcgtcacccgcggcattgccaccctctccgttcgccttgatcgaatcctgcatcagcgaacgcgttatcgtgtttaaaatagtgtcgataatcttacgcccggttgcgggaaaagtaaagtgagcgcgaaccggcgcggttagaagtcggagtgtaagcggccttaagcgtgatggcccggttttggccattgcgcttaaggtccttacacgcagacttctgcgccggtgagcgcgttatgggcgtaaaccagaacgtaagtggccttaagcgtgatgattgggctttagccattgcgttttagggccttacacggagactgctgcgaacactctacaagttgttgcatcggaaaacaaggtggtacacttaaacataatgacttcacacggaggttcgagatggctgatttatggcggacgattgctgagcgccacggtgaattgctaagtgcactgggacagcatattgaaatatcactgattgcgcttattttagcggtggtaattgcgattccgttggcggtttgggttcagacacatgccaaagtcgcggcagttttgcttcagattaccggcgtgttgcagacgattccttcattggcattgctggggttattgattccgtttgtcgggattggaacattgccggcgattattgcgttagtggtctatgcgctgctgccgatttttcagaatacatatatcggcctgcgcgacattgatccttcctatgaagaagcggcggatgcattcgggatgagtcggttgcggaaactatttaaagtcgagttgccgattgcgctgccggtgatcttgtcaggcgtccggacggcgatggtgatgatcatcggcacggcgactctggcagcgttgattggtgcaggcgggttgggaaccttcattcttttgggcattgaccgtaacgatgccgcactgacactcatgggtgctctcgctgcggcgttattggcgattgtcttttcgtggttattgaacttgatgcaaaaaattaactggaagctgagcgtcggggttgtggcgttggcggttttcggactcgttggcacacaggtttacagccgagtgaccgcgccgaaagaaacgatcaccattgccggtaaattaggcagcgagccggatattttgattcatatgtataaggaactgattcaaaaagccgatcctgatgttggggtcacattgaaaccaaactttgggcaaacgagcttcttgtacaatgctttgcgaaccgataagatcaacttgtacccagaattttccggaacggtcttggctagtctgacgaaaccttctgcagcccaacagcagcaggtggcggcaggtaaagataattatccattagccaaaaaattgttggcccagcaaggcttcgcttatctgaaaccaatggcctataacaacacatatgcgctggtggttaaagcaagttttgccaagcgttatcagttgcaaactatcagtgatctggcaaaaatcgcaccatcaattcgtgctggctttgacttggaatttattgatcgccaagatggatataaaggcattcaatctcaatatggtttgcaatttaaggtggattccatggatgcctcgttgcgatatcaagcattagatcgcgggcagattaacctgactgatggctacacaactgacgcgcaactgcgacagtatcatttagtggccttgaaagatgacaaaggtctgttcccgatctaccgcggggcaccactcatgcgggctgcgtttgctaagcagcacccacgacttgttgcggcgttgaaccggttagccaatcacatcaccgaaaaacagatgcaggcgatgaattatgccgtgagtgtgcaaaatcaaaaagcggccacggtcgctcatcgctatctcgtgcaacatggtttgctcaaggaggtgcgctgatggcattgatcagtctggaacacgtcacgaagacttatgatgacaagccggttgtcaacgatttgagtctacaggtcgatcaaggtgaactgttcgtcctggtcggcacttccggcagtgggaaaaccaccacgttgaaaatgatcaatcggctggttgatccaacggcaggagtcatcaaatttgccggcaagccactgatggcatataaggtgcgtgatttgcgttggaatttaggctacgttttacagcaaattgcattatttccaacgatgacagttgcacaaaacatcgcagtcattccggaaatgaaagggtggtcacggcaaaaaatccgtacggcaaccgatgacttattggcaatggttgacttgccgccagccgagtatcgagatcgcatgcctagcgagctttcaggtggccagcaacagcggattggtattttgcgggctttagcatcgcggccgaaagtggtgttgatggatgaaccattttccgcgcttgatccaatttcgcggactcagcttcaggatatgttgctgcacttgcatcgggcaatgaaaaccacggttgtttttgtcacgcatgatatggctgaagcgatgaaactcgggaatcggattggtgtcatgcacaacggtcggctcttgcaggtggataccccggaagcaattgccacgcagccagccaatgattttgttgctgatcttttcaaaggagcgcaggcaaatcaagggttgcaggtgacattgagtcaattagccccatttgcggttgagcaatcagctgatcatgcagttggcggtaatttaacgttggccgaggcgctgccgttgttggacgcccatgaaacattgcgggtcaagagtgaccatggcgtcttcgtgattgatacgcatagtgtggtggcgtatcttgcaagtgcatttgttgatcaggacacagaaacgaaaggatgatcgaaatggcgtatgattatgacacgattgtcattggtggcggtcccggtgggttggcggctgcgtacggacttgccgccaagcaaaaggtactggtgattgaaagtgatctgtggggcggtacctgtcccaattcttgatgggatcccaagaagatgctttatcgcggagttgaagtcaaaaatgctgctttgcggatgaacggttttggcatcagcggcacggctaagattgattggccgtcactcatggccttcaagcgcagttacacaaccggtattccggccgggacgctaaccggcctgacacggactggcattaaaaccttatacggacgcgcccaattgctcggccaacatatggttaaagtcgggtcgcaaaacgtgaccggagaacatattgtcattgccaccggtcatacgccgcgttttccggatattcccggtgccaatttgttgaaaaccagccgtgattttctggacttggacgaattaccgactagcattgcgtttattggtgccggttatgtcagtgtcgagcttgctaacattgccgcggcagctggagcagatgtgcatatcattggtcattccgaccgacttttacgtgctttccctaaagttgccacagaggcattgaagcagctgttgcttaaaaccgggattcattttcaccctaatgttgaactgacaaaaatcagtccgcttggaacgatgacgcacttgcatgcagatgggtttgatctcaatgtggatatggcagttacggcgatgggccgaattgccaacgttgcggatttaggcttggccaatgccgggattaaatccgacctccgcggcattccggtcgatgatcacttgcggacggcggttgccaatatttatgcaattggggatgtcaacttaaaacctcaaccgaaactgacacccgttgctggctttgaaggccgctatgtagcccaacagattcttggcagtcaggaaccgattcattatccagcgattccaaccatcgtctttggccccacagagctggctaaagtcggcgtggcgcttgaagatgccctagccgcaccggaacagtatcaggtcacccacaacgagacaacgcattggtacacatacaaccgcattcaagacccggatgcgcaggtatggacgattgttgataaaagcaccggcaaacttgcaggcgccgttgtcctcgcgagtctggctgaagacctcatcaacacctttgccgctgcaattgatgccggtcaggaacctagtgatcaactggttgctcagttgcccaacggtatgaacagcagtgttgaagaagcaggctttggcttttccggtggggagcggcagcgtctttcactggcacggatactgttgcaggatgccccgattgttttgctagacgagccgactgtcggatta

SEQ ID NO: 26 - DNA, 8885 bp, Lactobacillus rhamnosus
ataggcaagggcggattttttgtttcctcctcggcctcaataaagtttgaagtcaaaatgctatatcgggttgcccgactaaagaattcgcttgagtatcaacatctgcatttattgttattttgggaggaacgttatgtggaaagttattaccgatgcagttccgcaaatgatagcagccggcattaaatacaccattccaattgcactcgtgtcatttgcgatcggcctgatcatcgcacttgtaaccgcattgacgcgcatatcggttcgtaaaggtattttgatccgaatcgcaaaaggaatcgccgttttttacgtttggctctttcgctcaacgcctttgctggtgcagttattcatcgttttcttcggcttacccagcctcatcatcccgggtattttcccgcatggcatcaagttagatcccgcggccgcgggaattataacattctcacttaacacgggggcgtattgtgccgaaacgacccgcgcctcgctgttgtcgattgattccgggcaatgggaagcggcttatgcaattggattgccgcggcgactggtgctgcgcgaaatcattattcctcaagcactacgaacggccatcccgccactgtcaaatagtttcatcagcctgatcaaagacacatcccttgctgcctcgatcaccattgtcgaaatgtttcaagtcagccaacaaatcgcggcggaaaattaccaaccattactgatgtactcaatcgttgcgcttctgtatgccattgtctgcactttcttagcttggggtcagcggtatctcgaaaaattcacatcacgctacaatgccaatgcacaaaccacgcaattataatccgccattttgaaaggaagaaagctatgttaaagaaaaagttgtggttcctgttgccgcttgtggccttggtaaccttcacgctcaccgcttgcaccagcgcatcatctgacacgtcaaaaaacagcgacgtcaccgccgaactcatcaacaaaaatgagcttaccatcggccttgaaggtacttatgcgccattttcttatcgcaaagatggcaaacttgaaggcttcgaagtggaactggggaaagccttagccaagaaaatcggggttaaggcaaaattcgtgcccacccaatgggattcgctgattgcaggattaggcagccagaaatttgatctcgtactgaatgatattagtgaaacgcccgcacgcaaaaaggtctacaacttcaccactccgtacatgtactcgcgttatgccttaataacccgcagcgataacaccaccatcaaatcgcttgccgatattaaaggcaaaacatttgtcgaaggcaccggtacacccaatgccgctttagccaaaaaatacggcgctaagatcaccccgtctggcgactttaccgtatcgcttagccttgtgaaagaaaaacgcgcagacggaaccatcaacgcctcggctgcatggtatgcctttgccaagaataactcaaccgcgggcttaaagagtcaaaccctcaaagatagtgtcgttaaacccgatgaagtagctggcatggtcagcaaaaaatcgcctaaactacaagccgcactttcaaagggcattcaagaactacgcaaagacggcacgttgaaaaaactgtcgcaaaaatattttggcaccgatttaaccaccaagtaatcatgccattcagctagcaaacattgcccgtcaacctgcttcattgacgggcatacataaaagaacactattcattaaaggaggtcgggtttcaatgacccaattcaataccaaactcgttcatggaccacaactaaatgtcgaccaagccggtgccatcgtgccaccagtataccaaagtgccatgttccgctttgctcctgatggtcaggaaacccactgggactatgcgcgcagtggtaacccgacccgtgaatacctggaacgtcagattgctacgctagaaaatggcgatgctggctttgcgttttccagcggtgttgcagcgattgcaacggtgctcgcgattttccccgaccacagtcacttcattattggtgattcgctctacagtggcaccgatcgcctcatcaaccagtatttttctcaacacggcctgacctttacaccggtggatacgcgtgatctggcagcggtggaagccgccatccgccccgaaactaaagcaattttctttgagactttttccaatccgctcctcaaagtcagcagcgtcaaggccatcagtgccctcgccaaaacccatgatctgttaacgattgtcgacaacacgttcttaaccccttattaccagcggccacttgacctcgggtgccgacatcgttctacacagcgccaccaaatacctcggtggccacgggtgacctcatcgccggcctcgttgtctccgctcaccccgacctcagcgagaagctcgctttcctgcaaaacacgatcggtgccattttaagcccgcttgactgtagcctcgtcacccgcggcattgccaccctctccgttcgcttgatcgtgaaactgcaaacgcccaagccgtcgccgaatttctagcgcagcacccagacgtcgcccacgtttactaccccggacttaaaaacgatcccggttacgcattagcccaaaaagaaaccacgggtgccagcggactcctgacgatcaaactagccgacaacattgatcccttaaagttcgttaacagcaccaaaattttcgactttgccgactcacttggcaccgtctccagtctagtcaaactaccttggtttaagctcccggaagacaaacgcgccgattttggtttgacaccgcaacatgtccggattgcaattggcttggaggatcagcaggacttgattgacgatctgcagcaggcactggttgcagcggaaaaatagtatccaaaataatatctattacttttgctaaataggcgcgaggtgacaaagtgaaacatgctcggtcattaagtttgaaatactggttgatcgttttctgtacgattatcattctcagtccgattgctaatatgataagcacgtgggtggaaccgtcagcaacctacattcggttcattgctgttttcttgattgcatggttggcactgaaggtagctaaatatttcacaaatacccaaaagacgaaatagtgcgtttgtcacttcttaattaccgttctgcagaatatagcgtaatcaactaacaaagatattctcaattttgattacattctaaggcgcatttgatataagctatccaaagcttaaagagtggtggctttcaatcctgcctaccataaaccgccagttaacttatttgtcatttgatctggccaaatacatcagcggacgtaaaaatgtgctctgtctatcactgttacgctaacagtgataaacagggcacattttagtgtgcgtttagatattttatcaatcgatgctaatcttcattatatggccatccgattgaaactggttggttaagatcagccgtcccatctgtttcaagcgattgcaacgcctgcaatgcaagtcgcaaccggctcgtgtaaccgtgccagttatcgtcatcccaacctgcgtttaaagccggcacatacggtaaaaagttaacgcgttgggctgtgatcgttaatcccgccgccttacagatcaacggccattccgtatccgtcagcaaaccattcgaattagccaagatatatctggcagccatctgactcaccgcacagcagccagcagtaatatccagatcaggtaaagcaaacacttcagaagccgccttattcgtaattgcctcggtttctcgccaagttgccggataaccccgcatgttttctgaacttcgcccaataatctgataaccatcatcaactcgaagctgggcaataaaggtcttaaactcagatacatttgcctcaatccctgtcaccactttatcaaaatcgcagtaaaaaaaagaagcgtggtaacgaacctgacgcaatccaaaatcaagcacccgccgccgcgcatcagccgcgccacgaggttcaatgatgcgaacatgaacgctgggaaaagtttgcaataatttggtaatttcacgatctgtaatcgtactaactgtcagataagcagccgagaaactatcactaactactgccagaacccgttttaactgcggcaaagacacattgggatggtgaaaccgttgcgagtaagactggttgcatgctaaccacaactcctttgcacgttactgttgacatgggctaggactaacgaatcttatcgaaaccgagaattaacaaattccggtttctccatctcgtgcttgccagttgtgtcccctttttgtcccccttaacgtaatcctgacactttctaaggtgagctaaatcaatgagaacactgatataaaggcattttcatttctaaagtacgctaataaacgctaaataatgcctccaccgagattcgaactcggatctgtggtttcgaggaccattatgctatccattgcaccatggagacttacagattccattataacaatcttgttcaatgttgacgcacgcaatcttccctgccgctcattttctcaagacaaaaagcgacgatcaactgactcaattgatcgccgcttctgttttttgcttacctatagctattggttttactaatcatcaaacttaaacaaatccgtcgacaaataccgttcaccattatccggtgctacagtggcgacactcttgcctttgccgagtttcttggcgatttcaatcgcgccaaaaatgttagcgccagcggaaatgcctggtaggaagccttcttcatggctgacgtggcgagccatgtcgatagcttgatcgctggtgacttcaatgatgtcttgatagaggttcgtatctaagacgtctggaataaaaccggctgagatcccttgaatcttgtgcttgccgccatggccttcttttagcattggcgactccgctgcttccaacgcatagatttgtacatctggattgatcttacgcagagcccgaccaaccccggtgagtgttccgcctgtgccgacgccggctacaaaggcatctggggtgccaccatcaaatgaacggatgatttcttgtccggtcgtgcgctcgtggacgtctggattggcggggttctggaattgcattggcaagaagtagccattttccttgcttaatgcttctgcttttttaattgctcccggcattccatcggcacccggcgtcaaaatgagttcggctccgtaaccacgcatcaaagcacgccgctcaacactcatcgtttccggcatggtgatgatgaggtgataaccttttgccgccgcaaccagtgccagtccaatgccggtgttgccggacgttggctcaacaatggtgccgcctggcttcaagacccctttatattcagcgtcttcaatcatcgccaaggcaatccggtccttgactgagccgccgggattaaagaattccagcttgacataaacatccgcggcgccttcaggtacaacgcgattgagcttgagtagcggcgtattgccaattaaacctgtaatattatctgctgctgttaccataataaagcctccctaaataatcggcgaacggttttcattgcgatgatccgcgatgtggcgaacccaattatcaaaaatcgttcgctgcgttttcttccaattaaacttcggatggtcatagtcgtttttgtgatggtaatagtgtttagcccgtttatagctaatctcagggtgtgcggccacttcccgcttgtattccgaatccaggccccaacggtcatattcaatatgcgaaaagataaacgtttgggtgtcagtcggttccgtcaccatgaagagttttcccttcgttgttgtcgcattgatcgttaagcggggatcgtcgcgaatatcgcgtacatccatctcggcataccgagcatgtggggacttaaagccttctttcaaaccttttaaaaatgggtgcggttcaagaattgtttgcggataaacgccgaataacttgtgcggaagaattaacttgctgacgccgaaaaagtaattcagcgccaccattccgccccagcacaggtacatttggttgggcacatgctgacctaatgtctttagcagcgtccgcacctcggcgatatagtgaacttgatcaaattccagcgtttcaatcggggagccagtgatgatgaacccgtccatcgttgccgcttcgtgaatatccagcggctccagaatcgagctcaccgcttccggtacttcccgaccagcgtaatgggtcatgggatagtaaaaatgcaactcaaccggaatatcggtgtgactcaaaacgtgttgcagccgcgttttggtatcggctttgtcgtgcatcacgttgagaatcccaattttaagtggtgcttctgtcaaggttcacctcccaacccggccaattgactcgcatgcaccggcaaaattttgaaacgattgcctgcagacaccgttaagcaaagtactgccgatgtctcacctgcacgaacacatcaggagaatatcttgataaggctgatagcgccaaccttcgcttgttaccaataaggtttgccatattttaataccctccctttcagtaactatatactaactaaatgtaagatcgatagcaacctttggccttaatttattcgcgtcttcttttcgaataattagtttttaaatgatcttcgtctagccaactttaaccgttcataagtaaatgatatcccgcgctacaaaaagtggtcatacctatataattcaaaaatataaactcggaaaattccaccttattaaaataaacatacctctccgggtgttaaatagttcatgttgttttaaaatgtaagtagttctaagtaccttttaaggaggttttttaatatgcgcacgcacacttcaccttccatcgttaaactagccgcagttggggcggttgcggggttggtttccggtttagtcaaattagggtgggaaaatattctgccaccacggacaccggaacgcgatgcgactaatccaccgcaaacttttctacaacagcatggcttgacaccggcagaaacacacgcaacctacacctattcaggccaccagattccatgggttagtctgctggttcatttcggcttttcatcaagcttaggggcactttatgcggtagctggccattatgttccgctgttcaaactgggttatggcagtatgtggggactgggtgtttgggccggcgcgcatttatgggccatgcctgcactaaatatcgtcccagccgcaaaagatcagccagctgaagaacatctgtctgaagctgtgggccacatggtgtggaataccgtcaaccaaatcgttatcagcgacatgttgcgcgaaaaacacgcctagtcttttgcagatgctgaaacggtaatcatcatgagcgcgagccagctcgggtaaaggtttgagggccgctttatactcgcgttttatcatcccgctttgaattttttccgcgtgctgattcggcgttcaatcccatctaagaaaggagcggtgtctgtgtcaaaaccctctacttcttggcaaaccaaatggccggaacgcattagctatggtttaagcgatgcagcagataatttggtgtttcaggtgatgacgtcttatctgttgtttttttataccgacatttatggcttacaagccggcgcagttgctttactctttctcatcgcgcgaattgccgatgtttttgagagtccgattgtcggcttgatgattgaccatacccattcgcgcttcggtaaaagccggccgtttttcctttggtatgccttgccgtacgcaatctttgccgtgctaacgtttgtcacgccagggtggtcggcaaatggcaaactcgtctgggcctatgtcacttacctcatgcttggcttcttatacacggcggtgaatctgcctattacctcggtactgccgacgttgactcagcagccacaggaattaaccctgctgggcgtcatccgccagttctttggcagttcggtgcaaatcattgtcgctgtcttcaccttgccattggtcgccttcttcggtcgcggcaatgatcagcgcgggttccttttaaccatgacgctttttgccggcatctcgctcgtgctgattctgaatacgtttattcatatccgcgaacggtttactcaggaaaagatcgctcaccaaccgctaaaagttgttgctaaaattgcggtgcataatcgcccatggctgctgctatcattgattatttttacgtactggctgttgaccgccattaaaaatcagaccacggtttactattttaagtacactttacacgatcaaggcttggtatcatgggccaatagttttactttttcttcgctaatcggcgttttattgatcctgatcagctggtcggtttgccgcttattcaagttgctcagcggctaaagactgatgttccgtcgatgctgatgcagtatctgaccagtcctgaaggcttcctggatatcttcggtaatgtcttaaagtccgccgcttcagagcgtttctatgtgggtggccgcttaaatttaatggactatctcggcgactcggatattcacgagttgaaaaagattatgtccttgattgatgctgatcatggtatcttactgaactgcttggcggaccggttcgccaaacgccggttacggttcgtctaggcccggagttaaagccaattgatctggccaatctcagcttgattaccgccagttatgatgtcggtgaccacggcacgggaatgattgccctattagggccaacccagatgccgtattccaagat

SEQ ID NO: 27 - DNA, 7411 bp, Lactobacillus rhamnosus
gctagtttgcatataatcattcacatgaattgagccatcatgattcattttaacctgaccaaccaacaactcggtcatcggacgaaaaccaacgcagacaactgccaaatcagcttgaatctcaccgtgatccgtctgaatgaaaacatgctccgcgtcactatcgaaatggcgtgccaccgtgttgacttttaattcaacgccatgctccgttaatactgaagaaatttctcgactaagcggtaaatccacataatggctcagcaacggcgcaactccattaattaaaatcacgtgtttttgattacgactataagcctctgccagttcaacgccaatgtagccgccaccgacaattgcaatcgtttcggcatctttggcactctccttgattctacgtgcatcatcataacttttacacatcaagacccgcggaacactcacaccggaaaccggtggaataaccggatagctgccagttgtcataatcagcttgtcgtacggataatgctgttgtgtgcctgtcttcaaatcttcagccacaatcacatgaccggcaccatcaatggataagacgtcatgttttaagtgaacatgcacgttgggacctaatgcttcgagtgaggccggcgttgcgtaaaacatgtcctccaaccgcccgaccgtgccttcaaggtacaaggcaataccacatgaaagaaaagagatgtcttcacgacgttcaaaaacatctacttcccgtttccgggtgcctcatcaacagttcgcgcactgccgcagttcctgcatgcgtacagcccacaacgacaactttcatcagcatctgccttccctttctagatggttaataaggacattatgacacgaaaacggtgaaacctaaagcaagtcgctaactgcttagggacacttccaagtataataaatttgttacttcttaatttatcatctcataaaggagcagatgcggcatgcacattacgcttatcggtgccgggccacgtggcttaatgcttttaggtcggcttatcagttggcaacggacccgttatccccagcgccaactcaccattttcctagttgatccgtatccaattggcggtcgcgtttggaagatcgatcaagaccctaatctcattatgaatactgctgcggcacaaatcaccttatttaccgatcaaacagtgacaggcgtgggaccgtttattgccggtccggacttaagcacctgggcgctcacgcttgctgccgattacctcgatgctcaccccgaaattaacaaccgttcgattctgatgcgccaggctgccaatctgggacccaacagctatgcgtcccgcgcgttgtacggcgtctaccaacagtggttctttgacttgcaaaaataccaagccggcaccaacatcatcacctataagcagcaaaccgtgaaccggctagataaaaaagctgccggatttaccgtcaccaccgaccaagagagctggcaaaccgatcaagtggtcatggccttgggaaatctaaaaaactcattgacgcgcgaccaaaaggcattgcacgattatgcgcaaacacaccagctcttttacctggaaccgggtttccccgaagaaggtgatctcagcggcatcgaagcacaatcgccggtcattattcgcggactgggcttgagtttctttgatttgatgagtcgtctcactgaaggtcgcggcggacaattccaaaaagcgccagacggtctgcttgtttatcatcccagcggccgcgaaccacatatttttgccggctcccgccgcggttttccttatcgtgctaaaggccgtaaccaaaagggaccgggtgaagaatggcagccgcatttcttgacaccacaacaaattgacgcttggcaaactcatggcgaagtgagcggtcaaaccttctgggaagccttaaagcacgaagccgagttgatttactatcggcttttgttgccccaacgctacccagaaattgacgaggcagcttttgaacgcgattttatcgccgaccctgttgcccaccttgggagcactgccaatcgccgctaaagatcgtctcgattgggatgctttggctgatcccaccaaggcgcatccaagcggccacccggtaccaagacttcatgcggcattatttgcgccaggatgcccaagaagcgatgcgcggcaccaaaaccggaccactgaccagcgcgcttgaagttttacgcgacatgcgtgatcccattcgccaactcgttgagcgtaatcttctcagtcaggatcaatacctggacttcttcttgcgctggtttaactcactgaatgattttctttcaatcggaccgcctgctttgcggattgaccaactgcaagcactaataggtgccggtatcgtcactattttaccgcccggcatgcagatcaaaggtattgacggccaatttcttttaaaaaccccgagcgatccaaaattttcgcttcaagccaaaaccttgctagaagcacgcgttccggcagtcaatgcgcccactgcccaaaatccattagtacagcagctgcttcatgacgggtacgcacacacttatgaactgcagctcaacgccgacaaacgcttccagtcaggcgctattgccattgaccgtcaaacccaacagctacttgaccaaaaagaacatccacaagccggcctcttcttctggggcgtcccgactgaaggcgttcactggctcaccactgccagcccgcggccactggtcaatgatgtgagcctcaaaaccgctgaacaaattgtcaaagtgatttttgggtgattcactggtatcgcgatatttgaatatcaaccaaaaagttcaggttacctcatcacaccagaggacgacctgagctttttcgtgcattgacatctgactgatttaatccagtttgctgaagattaatcatgtcagctcaatgacaatttatctagccgatctgaattagaagatataactttgccatccagctggaaaagcatcggtttgcttagtttcatttatgaacatttcagcttgatttttaaatgcaataaagaaatttgtcgcaccaagttctttttgaatggcgataattttttcgacttgatctttgtgcgccgccgtaccgtcctcacagtagatacaaagcgcctcagcaagtgcaatcagaaaccgttctgccatcatgccatcttcaacatgactatctttcatcactcgcaaatagtgtcttgctgtcgttagatctctagcagacaagtttacgattacaacgttgtataacaaattgataatcagctgaaaattttggtgaatctcccaagccacattaacttgagccgccaattcacgcgccagttgattgacagttcgcaaaggtaaagctgatatcgtattaccaaaaagtagcagttcaaaccgggtccaaccatctacatgaaagaggtagtccgtcaaaacgtcaatatccgcttgggaaagcgtctcaccggtcatatcagcgatcatagcattaaccatgattaaaataagttgattatattttcccggaaacgccgtaaaatgttctgccgcgcgttcccgcaccaattcagcttgatcacgattgttgttaacaactgcttttgtaatatccgctaatatcgactgctcatacaaagcctcctgaaacgccagtgcattcccaaactcagcaaacgtgacatggagacgttccagtaatgctaataatttagtagccgatatttgtgttaggtttcgttcgaacttagagagttgtgcttttgaaagaattccagtactaagatctgcctgactcattcctttacgttcgcgtaagttattaataacttccccaatatttttcacagtctgcctctttttcatatatgaaacgtttttaattaaaatcatattagcacatatacttacactatcaaataccacgatcgccctaagatgcaatacacaactttatcagaaaggctgatgtcttatgaaaccaacaattaaactattagcacatcaaaaactactgacgctactgacaacacttttgattttgattgaatcgcttggaaaggttacaagttctttaaccttggcaccactgactgatcaacttattaacaagaattttcggggtgtgtttttctggttattggcaactatttcaatttggggcgtgacgctgacgattgcttatgtcaattcgttgctgaaagctcagatcattcgcaaagtcaccaatcaacttcgaaccgatatcgcgaacgggctcaccagtattccggtttatgaatataataaggtcaaccacaatgaatatgtctcgtggttgaccaatgatatcaacatgatcgaacaaaatggtttacaaacattcttctcattgctaggcaatgctgcaacacttttatttgccattacttctttggccttctaccattacagtctagcctttgctgccattatcctgggcctcctcaccatgaccatcccacaatttttctcaaaagttatgacacacgaaacgaaccggatcgcttctgccaatagttcttttttagagaagtcagatgatatcatcggcggtttttcagtattttttagtcataacttaggtgacagattcacacaaaaactagcggacgcttctgattaccaaggaaaagaaaaggttcgctacgccagaaacgttgggcttgttaacctactcatcagcggcgtgaatgtcactgcccaaatgatcgttctggctttaacttgtctattagtcatcggtggctatttctccgtcggggtgatttcggcaagtggctcgttggcaggaacagtattcaataatttggctggcatggtgcaaggaatctttcaaatgaaatccgtcagcgtcttacttcacaagaacagccatttaagtcagttaccacgtttagccgaagatcggtcatttgaccatgcgcttaccctggatcacctctcgtttagctatgacgaaaagcccatcattaaagatgtttcctacacttttaaacgcggaggaaaatatgccatcttgggaaaaagtggtgttgggaaatcaacacttatcaatcttatgagtggaaggctaagtgattatcaaggtgcaatccatgtcgataacaccgaattgaaatcgctggcgacaaccgctttaaacgccaagatcgaactggtagaccagaagtcctatatctttaacgaaagcgttcaggaaaatatcacattaggggttgctaaacaaacgaatgcattaacaaacattgtaaggttcctaggaattgataagtttgctaatctaaccacaaacattcacgaacatggcagcaacctgtcaggcggccaacgacaaaagctagcgttggcacgggcactagcatttcacaaaccaatcctaattgttgacgaggtgaccgctgggatcgacaccgaaaatgcccagacaattgaagatgctttattagccaacaaggagcttactgtcatcatgattacgcatcatctcaccgaaaagactaaatctcagttgaccggaactctcgaattagcataaaaaacctgagttgagaaaaattcagttctcctattttccaacaaaaaacgagccgccaacttggcagctcgtttttgttcacaatcattgactaagcataacgcatcgtagcgccgactttagctgataaatgggcttcgggcaaaagttcaacctgaccgccgtggcctaatacaatgtccgccaatgtatttaacagattcgcatgctgagcggccttggaatcgcgctcaatctgatcaccttcaagccgcgcgtgaatgcgtgcgccggcttgaacaaagaggatggcgatttgtccacgcaatgccgccgacacaatcgttgccaattcatcggtgtaactgccattgccgcgtgcgttttcaatgacattagcgaagtgttgtcggcgccgatcacgcaatgtggcgcgcactggttcaagtaagtcatccagctcaacaaaatcaagcgttgccggacttttgaccactgcaagtttcggcagtaaatgatggttcttggaaatctcgcggaataccgctacattctctgctaagcccatgagaaccagcggcatttttttaggattcgaataatttgtcagtaaatattgatcaactgcctggtagaatcgccgttgatcgcttgccttctcggcggatttttcgttgtgcccatggtaagtgacgtggccaccgccttgagacacactatttaactcgccgcctcgaatttctgttccaagtgtgcctttcaatgtttgtggcgcatcgtctggtaaggaaaccgagcgcacttggtgaccatggttatggtatagctgaatactatcagcgttaagcgccagaatatcaaaatctgttgccgttgcctcatccagcatcaaaggcaaaatctgcggcacttcagttaccattgccacttcatcaactgcttcatacattggggttacatacgtttgcgcaccgttcgtcaacataccaatcccgtttgcttcgctgtcttgccaaaacatcggatcttgctcatatggttcaagttcggcagcatatggcgcaaagtcggtgtccgaataggtttccgccatcaccgtcttgacatgtttaagcatattcttgaaccggatccgcaacttctcaaccggtgtatgctccggccaagacatgtacagtgatacatacggaccctgtttggtatccgctaaaaattgctgcaacgtcggtctagtcgttatatccataaaaatgcaactcccttccggctgtagcctaccttagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttggcttcgacccagctttggcccattaagtttaatgcctagcttcttacacagattgatgttatctcgcgtgcgatagagagtatcgaccagcacctcatgcggatattcacccactaggtcaaaagcatggtcaagcgttacttcaagatcagtgctttcgttaaatgaattgaagtcgaaacgctctacatcaatcacgccatccaacatggaacagtcaatcttggcgcccaactcaacggactcttcgtgccttcc

SEQ ID NO: 28 - DNA, 2326 bp, Lactobacillus rhamnosus
atgtgcgagtggcaatttattgccttctgcgcctgcaatatcttcaacgtcaccattgcgaaacggtactggcccgataccaaagcgctgcaacgggctgtttaacggttcaaccgtcaaatcgtagtcgtcaaagctgccatccgcctttaatgcaacgttgaaggcggggtggaaccctaacgcaaacggcatcgaattgctgtcatcatttgtcacggtgtaatgaatgctcagaccatcttcggttagcatataagtaacggctaaagtatatttaaacgggaactttttcaaggtttctgaattttggtgctgggtgaacgtcaccgctgagtcgctatgatcatttttggaattttgggagcggtagttgcttattttggagccaaaactttcgtcgcgccgaagtatgaatcagacacgtcattactagtaaatcggaagcaggataataatccaaatatgcaattgaatgctcagcaagctgacattcagatcatcaatacatataaagacattattacacgtccggtggttttgcagtccgtggctaaagaactgacaagtccgcaacgtgttgttactgaaaaagccaaaaaagcggtttatggaacgcggtataacgctgttacaggaactcgcgaacgttatgttgttgaaaaagcacaaccagccaaatataaattgaagcctgcaaaatattcaaacatttcttctgaggacttggcaaagatggtttctgtttcgactcaacagaattcacaagttttcacagttaacgtcaaagacaccgacccagtacgtgcacgcgatattgcaaatgaggttgcaaaagtcttcgaaacaaaaattgccaaaatgatgagtatctcaaatgtgtcggtagtttcaaaagctacggctaattccaaaccggtgtcaccacgattaaatatcattgcacttgcaggtctagtgttaggcgtccttctttcactcgtctggggattaattcgtgaactgacagatcagacagttaagactgttgacttcattacggatgatcttggcttagttaatttaggtgttgtgaattatgtgcagcgaatgagagatatggataaggctattaaagcaactaaactttcggaagatgacaacgtgcaagatattacagaacccggctttcctcaacggagtcggcgacgtgtctaaagggggaagtaaaaatgagttggtcaattaaaaaggtctttaatcggcataaggaagaccaggagacacaaaagaacggcgtaatgttagtggcctttgctgagccgaaacatgttgtttccgaacagtttaggacagttcgaacaaatattgagtttgctggagcagcattagataaatgtcaggttgtcatgtttacatcctctgcaatgtccgaggggaagtccactgtatctgcaaatgttgccgtaacttgggcgcaagctggtaaaaaagtcttattgatagacgctgatcttcgtcgtccaaccgttcacgcaacatttagaaaacttaatttagatggtgtcacaacaattttgacaggaaaaaataaaccggaagaagttgttgaagatacttttgtagacaatctaagtatgatttcttctggaccagtcccgcccaatccgtctgaattattgaattctaaacgaatgggtgaactgttggagtgggctcggtctaatttcgacattattgttcttgacgcaccaccagttttagcagtgtctgatgttcaagtattagttccaaaaactgacggagttgtggtcgtcgcaaatattggaaagacattaaagggagatttacgtcgaacagttaaagttttaaaattggctcaggctaaaatattaggttcagtcgacggggttaaagctaagcatggtgacagaggctacggttatggctatggttatgggttacggctaccagagccagaagtaaggaaaagtagtttttatagaacttgaagtgaaaatagatccccagtaccaagccgatgaaaaaaccgtaactcggtaatggccagtgggtcgtgataaccagaaccgctttagtagacaaaaggatcccgacgattgcgcctaagccaaccggggtcagaaagcgtaaatttttgcgcggattggcgcgaaagtgattaagtgcatttaagaggcgatcataaagcccaaccacaaccgcaaagatactgccggaaagtcctggaatgacaagtgcaatgccgataatggcacctttgatagaattaagcatgacatctccttatagatggatttattaatagacaaacacggataaggtc

SEQ ID NO: 29 - DNA, 13825 bp, Lactobacillus rhamnosus
ataccaaaaccgggttataaccccgcccgttaaaagggggttgaatttaaaaacccccccccaatggggccgccacaggaaaaatgggaaaaggcctgggcccccctttaaaatttaaaccccaaatagcccccttgtggctatgttttaggttaaacccccataaaaggcccgggccccgcccagttttccaaaaaacccgggaaaaaacccccgaaaggttaaaaaccctttctctcctttaaaaaaaatgttccctggggcccaaatctatgcggtttacaagcccccaaaaaccaaccataaaatttgggataaatgcggtaaacttttatcccacgcttttgccatcccggttccttggaacaaacccattaaaaccccggctgcaaacaccaaaataaccacttgaacggcatcgccaccattagcgccgatccgtttgctttggtcgcctaacttaggatagtttgccatcaaatcgatacaggttccgaccaagaacaacaacaatggcggcattgcaatggctttaataaaagaacttgcccccaatcaggcaatcagaacaattgtcaaaaaaccgttaaacaagaacatattcgggcggcgaatttcagaaacttccggatccactaccgatgtcatttcgtcaattttttcatcggttaactcccgaactcccaagcgtttccgttctgcgcgacccatgtgcggtgccacatagaagatcacataagccagtgccaaaatcatccctggcaacaggtaggtcaaaatatccgcatcaacttttaaaactgccattgcccgtgcagttggcccaccccaaggcaataggttcatgatggtattttgcagaataatcaaaacacccaggttcatcatattcatgttgagcttcttataaatcggaataaatgccgagcaacaaatcaaagttgtggtcgtgccgtccccgttgagtgaaacggccatcgcaacaattgcggttgccatcagcactttcattgggtcgccttttgcaatcttgatcatctcgaacaccctgaggagcgaaacatcatttttattaccgggatcgggcaggtatttccactgattcgtgctcatcgagtcttgaacaccatgaatcaggttattgataaaacgcctgtcgttatgttttacccagggagctacaacagtttgagcttacgtgcttttggcaagcttgatgacaaaaactactatcgtgcatttcggatcgaataggaggacatggggaatgaaaattaaggatctttttaaacgaccaattgaccgcaacatccaaggggttattaaagttgatcaagatgacgaagcaaacgttaaacaggaactagacgagtatgttgttacgcgtgagttacgtgaccattttgcagcgttctttagtgcttttgataatagtttgcagaccccgactgacgatatgggtgtctggatttcaggtttctttgggtccgggaaatcgcattttttaaaaatcgtgtcatatattttggcaaacaaaattgttgatggaaaaccagcagttgattattttgacgacaaaatagacgaccagatgattcttaatgagatgcatgctgcggcggcggcaaacaatgatgtcattctgttcaatatcgatgctaaggcgaaagacacagttgggtcagataaacaaagcattttgaaagtcttcatgcgggtcttcaacgaaatgcaaggatttaccgacgccgatttttggattgctgaccttgagcggcgtctgaccgaagctggaaagatggatgcttttaaggagcaaattaaagcgattgatgccaatcatcagtcttggatagagttgcgtgacgcatattatctgaataaaggtacgatcaaggaagcaatggtgaaatccggattctctgacgaggcgaatgctcagggtttcattgaaacgctgagcaccgaataccagatcagtatcgatgattttgctgctttggttaaacagtatatcgacaaaactggacgccgggtcatcttcttggccgatgaggttggccagttcataggtgacagtgtacagcggatgcttaatttgcagacgattgtcgaacaactgggaacgatgacacgcggcaaatcatgggtagtcgtgacttctcagcaggcaattgacaaagtgacggacattgcatctggacaagacttttcgaaaattcaaggtcgcttcaaaacacgtttgtcgatgagctcggctaatgttgatgaagttattcgcaagcggttattggaaaagactgatgttgccgagcagatgcttgaagatcagtattctgcaaacgctgcagctattaataattcaattgatttcgatgatggtgtagagcggccaaaatataagtcgccaaaagattttgcacaaaactatccgtttattccatatcagtttaatcttctacaacaggtgctgactgcgattcgtgaaaacggttcggatggtaaacatttgtctgaaggcgagcgatcaatgctttccctcttccaagagtcagctgaagctatgatggatgcggacacagagacgcttgcaccatttagtcgctttttcgatggtttggaacaattcttggatcatacccatcacatcgtcctagtgcgtgcccacgacaatcctgctgttaatccgaacgacgagaagagtccgtttgcactgcagctgcttaaagtattgttcatggtcaagtatgttactgactttaacgcatcattgaacaatttgatcaccctgatgattagttcggtcgatgcagatcgaattgcacttaagaaaaaagttagcgatgcacttgaggttctagtcggacaaggttacgttgaaaaaacagtcaagggttatgactttttgactgatgctgaacaagatattacacgcgaaatttcgaaacaagaagtgattgacaatgaggttgccaaggaaattggggattacttgttcaatgccaagccaggtattgcaacgagtttaacttatcccaaactgaatggtcgctatgtctttgcttttaatcggaaaacggacaatatttttggcgcacagcgaaacaagctttcagtgcacatcattacgccagtgaatgatgaatttcagagtgacaacgattatttacaagtttcgactggtgcgtggaatcatgatgtcttgattgctttaccacgttcgtcaaactttgtcgatgaaattcgaaatgcattacgaattcagaagtttgttgttaatagcagtgcatcaagcgattcacgttaccagggaatggtgttggctcgccaatctcagcaaaatgaagagttccagcacgctcatgaacagttgatcgcatcgcttgataatgcagctatttatgaaaacggccaattgattaatggcgaagcagggttcgatagtcgattagaacaggcaatgaagctcttagttgacaatacgtatcgcagtttgcagtacatcactgttgccaaatctgagaaggatattcgcgaacttttcgaaagtatctccagcctggcgcttgacgagcaagacaatcaagctgcggttgatgctgttctggattatatgcggcgcgagtcacagaataatacgcatatcaccatggaaagcatcttgtcgaagtttaatgatattccatatggctacacggatgaagatattcaatggctcgtcgcaaaattggtcgctattggcaaacttaagatgttttacaatggtacagtaatagatccgctaagtggtgaacggacaccgcgtgaaattgcaggtttctttactaagaagcaagcaattcgtaatttggcctttcagattaaagaagaagttgcgccttcaaagatcaaagcgatgcaggcagttgcttctgaagtgtttggaaagaaatcatttgaggctgataacgatgaacagagagccgcagaactaagaaaactaatcgtgactaagtatcaaactttgaagacttttgaagataaacctcaagattatcccgggcatgtgttgttacaacaaggacttcagttactccgtccaatgactgaaatgtctgattctggtgcgttttatgattatatcagtaaacataaagacgacttactggactggaacgatgattttcttgatgatggcattcgtgacttttattactcgcagtcaatgcaagatatctgggacaagggtttaaatgcgttgcgcgtttaccgagagtcaagtgatttcttaagtgacaatcagctacaagatacagttgacaagatggcaaagttgcttcgcttgcaaagacttcagggcgatacagccgttaaaatcagcgaattaaataagcagtttgatgaattatttagtgcggcttttgataagacagcggctggttatttagcggacattgatgatttccgtgaacgtggcttgacacgtattgaagaatcagcgatacctgatcagaacgtgaaagataaactagctcatgattttgaaaatagaattaaagctatttctgaggcagccacagatgccacaaccttaaatgaggttgtagcaaaaccagctcaagctagtgcgcaattagatcaactgacggaccgaattaaccatgcaaaggcgcaattaataccagtgcctgaccattcagatgaggacaacactggcggtaagcataaggatccagataagcctgtggttcccaaggtcgtttcaccacaagagaagatcgtcaaactggaagaggttcttcacaagggtgactacaaaatcacaacctcgactgatgttgataagctaactgctcagtttaagcgctcacttgaggctcaactgtcagataacacggttgtgacattgcaaatcgattagtataaagcttgacagtcatgaaaggaaccaatatggataaaaaggcaatcaagacatttgcgattcaagctagacgtgatctgattaaaagtatcaggttaaagatggagaatcttggtatcacagaaactggtgttgaggagaaatcagcggcatcaaccaatgagattgaatattatggtgataaggggctatttatcagtggccaagatattaagcgtcgccgtgatttggtttctcggcttaaaacaatggccaagcaggaagaatggcgggacgcattttcggacctcatcgaagaagttgcgtatacatggtttaatcgaattattgccattcgattcatggaagtaaatgattacctcccgagtgacgttcgagtgctgtcatcggaaacaaagcttaaagtacctgatatcctgcgcgaagcttttaatattgaatacgagttaggtggttatagctcggatgagcgtgcaatcatccagaaagcccttgataccgaagaaccgtccgatatggatgctgcgtacgtcattctgtttaccaagcaagcgaacgcgctaaatcaatatctccctgaacttttcgaaaaaacagacgatttcatgcaattattgttcactccaagctattcggttggggtcattcgtgatcgtatgctttatctggataccgatgtcatttgtcggcggccgtttgctgcgttttaccatgagtccatgactggtgttgatattgccggtgcgttggaccactacggcaaatggtggtttcatcaccggttgatgtggtttgattatctcaattccggcgttttgctgatgaatcttgctagaattcgcgcagatggtttattagcgcgctgccgccagttgttacagcaacggtggctgtttatgccggatcagagtgctttaaataagctggccaagtgtaaacggattctgccgcccaaaatacaatgagcagcataagcttgagccggatacggtttttcagcactttacgacatcgtttcgcttttggccgcgttttcgcattgtgacggtcaagccgtggcagattcatgccgttcatcagcagctgggattgcatgaatatgatgatttgctgaaagattatcgccggctagcacctaaattgaaagaagtgtcctaaatgccaactccaaccacggttccaattttcttttccgtcgatgatggctacgttccttgtctggccgttgctttgacttcgattcgggcaaataaaaatccacgtgtcaattttgaaatcaatattcttaataatggcttattacccgccaatcaaaagcggttggctgctttggggacatccaattttgacattcgctttatcgcgatggataaggtcacgcgacaaatcagcggtgatacgaacaaactgcgcggtgattacgtgaccctgaccatttattttcgcttgtttatcgcggatatgtttccacagtatgacaaagcgatttatattgatgccgacacggtagcagaagatgacttgaccactttgtttgcaacggatttaagtgataacctggttgctggtgtggccgatcggccggccgggtgttggtgaccgagatgtaaaattgctgtttaacgatgccgatgtaaagccgcaactgccgcttttcgtcgggcggctgttcactgattgcttcaatggcgttatcgagtaagttccccaaaatcaccacgaggtcaacatctttgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaaactaggagctaaagtaaaactggatgacgccgaggtacttttctacaatggtgccgacaaagtaatggcgcgcattattttacaggagctgatgaagcatgattccagatctgtccaaggctaacatttacatcatttgtggccgcaccgacttgcgcaaaggcattgatggtttggcggccttagtgacagaggaataccagatggatgttttcgataatgccctgttcatcttctgtggcacccgtaaagataggttcaaggcgctgtactggaccaaaagtggctttcacttctgtataaacgctttgaaaactgctatatgcaatggccgcgcgatcgcagtgaaattcgccgcctaaattatcgccaaatgtcacgcttggtcagtggtttagccattgaagaacgacgcaccattcaagccataacgcccgggcatgtgtactgatactgcgaaaaggaagccttttctagaaatcaaagaaaaggcttccttttcgtatggccgcttgatatactcatttcaacaattttaacggaggatccaaaatgcctgctgaagcagcagttacgcaagcctaattcaactacctcaaacaagaaaatgaactgcttcgtgaacaagtggcatttctgatgcgtcgcctttacggtgcgaagcgtgaaagtctgaccgatggtcagctggatctttttgagaagaataaagctttctccgcaccagagccgacggaaccagaagcagctggcaagaagccagctgagcggaaaaaaagaaaaggcaggaaggcagcacaactggcgaattttcctgaagtgtctgtgcatcatgaattaactgacgccgagcgtcagtgtccaaattgtaccgccgaaatgcgtgagataggtgtcactgttaccagtcgtgaaccagttcgtattccggcacatgttgaagtccacgtgcattatcaacacgcctatgaatgtcgccaatgttcagaccaactagatcatagcgtcatcaaaaaaacccccttaccacagccgttcattaccaatagttttgcctcacccagcgtccttactcagacgatgatcgaaaagtttcgtaaaaaggtccccgtctatcgccaagagaaggattgggaagaggttggtcttcccctaacgcgtcaacaaataaccaactggcatatcttggcatgcgattatggtttggccgatctttatgaactaatgcatcaagaactgctcaaacagacaatcgttcacgctgatgaaaccagctatcgcgtcttagaaagtgaaaaggtgaagacctactactgggtattcgcatctgggcactgtgaggataagccaatggtcctttatgaacacgccgattctcgtgcgactgaggttccgaaacactttttaactggttataggcattatcttcaaaccgatggttatcaagtgtacgagaaactcgatcaagtcacgcgggttggctgtctggcccacattcgccgcaagttctttgaggccatgggcaaacagagcaccacgaaaagtgctgctaaaacgggggttgattattgcgggcgcatgttcacgatggaacgcaaatggcggctgctcacaccagaacaacgttatgaaaagcggcaaggccaactcaagaccgaaatgactaagttctttacttggtgtgagaacatccataccttaccgcaatccaaattaggccgcgcgattgagtatgcactcagtcaacgcgaagccctagaaaacgtcttgttggatggccgtctggagatctcaaataaccgtgttgaacacgccgtcaaagaactggttatcggccgtaaaaaccggctgttttccacgagtttcaaaggtgctcactcaaacgggattattttgagtatcatgcgttcagtcgaggccaacggacttgattgccgcaagtatcttgaatacttatcacaaccttcccgttccttgtgatgccggggcattacaagattatttaccatggtcgcccaaggttaaagccaactgttcgcgttaaagctgatttaaaaaaacggcttcggtattccttacagcataaaggatatcgaagccgttttaaatgtaccttacaatcgtacgagtactttgtaggtattgtattattgaggcttattgtcagattcccgccatagtataacaaaaaagactccccctttggagagccacactcaccgatagatttactctttaacaatgcttattattcgtaagtcaaaattttacgattcaacttttctcacgaataaacatacaattaaactgaatagagctaacttttaaaacaattaattagtacgcacctgtcggatgaattaccacaagaatggttttgaacaagatcctgaaatcttcagcgacactagcatgatttatatagtgaatatctaaagcaaccatttcgtcaaagccaagctcattacgacctgaaacctgccacaaacccgttactccaggaacaacagccaaacgctgtctatcatactcagtgtactttacaacttcgcggggcaaaggaggccttggacccactaaactcatatcacctcgtaaaacgttaaaaagttggggtagttcatcaagactatatttacgtatgacacggccgatacgagtaacacgcggatcttgcttgattttaaacattgcaccatcaacgtcattctttttaagtaacttgtcaaccatcttatccgcaccagcaaccatagaacgaaacttccacatctgaaaacgccgtccatctttacctagtcgagtctgtgaataaaatacctttccatgcggatcatctaatttaatcagtactgctaaaactaaaaaaacaccgctgagcagaacgagaccgataaaactggctgcaacgtcaaaacaacgctttgacactaggtaggtcggtgtcaatcccccaagattaacttgctcaacgtcggtccgtctatgttcagatgctgtttccaaatttacccctccaatatttcaaaactaaataataatcccccgaattccctgttcaagttatcttataacattcttgtggtacgagcaacaaaaacatgttacaaatctgttactatggaaagcttcaaaattaggaaaagccacactctcaaatgcatctaggcttgtaaatcaatgtctaagcaatccttaacttcagagtcactcattgttaaatattgtgattaaggcaaactaaagggacacaatgaaactttcaataatcacaatataagcataaactttacagttaggtggcatacgtctattgataacatttaatgttgtcacctatcttacatcactatactaaagtatagcaaaaaacagacaaactaccaccttctcgggcaccatttttaggcctttttaggcccttttttagatgctataatacacactttcattgacttttgtgaaaacttcctttttcaacagtagctcagctgctatcgctccattaaaggtaagtaatttcgcacaaaaacctgattcacggaaaatcaaattaatcttaaactaaacagggctctttaactttaacgcgttaaaaacttgggttgaaaatccatagtgcatttatttaaaaaagaacgtgagaaagtcgtttattcaagtgtttgcataaaccacttgctttttctacctgtttgataacgagacaagaaatactcccttcgaattccgaatacataaggtaatacagtatatccaagacatcttaacaaatcttaaccacaaaccatttaaagtattaggcagatacttcctcacctttcttaatcttaagataaatcttccaagcttttctatatatcggataactaaaaccaattaaacaaattgctactttatctcgtataggcgctttatgatcttctaaaactggttttcgcaactctttaatttttgaaattagctgttctctaatttcttgatagccatcaacattctgcatctgatttaaggtactgatgtatgcatatagcactcgacgttgagaagcgatttgaagatccggataaacttttttaacttcacatgccatctgttctgtcatatcaattaagtccaacttgtgaagagaaaattggtcattcacaatcgagttatatctgaatggataactatactttgcttctgaaccaacagcaatactgtccgaggccagaaacgtcttatatgttgcggcgatgtcttcaaataaacgccctttgggaaaatgaatttttttgaagacccaggcgggatacaatttcgcccagactgaagtatcaatttggtcatcgtacaataagcgcttaacagcagtatgcgaatcaagcacagctggtccttcatacaagttcgtctgaattttgccatttttgtaaacgtttcggtgttgacagatagacatggtagcattgctcttaacgagtatgccatacagatactcaatataatctggatccacataatcatcgggatcaacaaatgatatccattgtccccgtgcaacggatacaccaaaattacgcgtatctgcaaccccaccatttgtctttgagaagactcgcactcgttcatcctgctgagcattttttttacagattgacagtgaacggtctgccgatccgtcgtcaactaggactatctctatattgacgtatgtttgcgcaaataaactgtctatgcatcgctgtaagtatttttcaacattataaataggaacgattatagaaactaaaggcatatctgacataagcatttccaccttccatactctaccatgtggtaattactggtctttctccatctctgtctcatacgcttacttattccataaacgcaaaatacacggtaaatcgatatccgacttcgccaccagaattcgctaatagccgaattaaaagtcgaatatatagaaaaaaccgtatacacaactgtggttattttatttgcacaaaaaagcgtgcaaacactcatacctcgaattgtgaggtttctggaaacttattgttcaaagcttcgataatactattagccacttgctcttccccttttgatgccgcagtatcattgatacagagaacggaatgtatggacctttcgagatcatatcgaatcttctcatgcaaagtttgttcataatattgaacaaaacgtttagactgaggctcaaactcgttactttgtatttgccagtatctgaatacccaatcggttaagtctgaaggatctcgaaagtgatgagaagacgttgctgacaaacgttgcgcctcaagtgaccatactgcctcaaatgtcttcttgagataaggttgaggagtatgcggattaaagaatcccggaatggcgtgccacggtaaagctagcatagaacgaattaagtttttaccgtatttaagattaaacactttgaaaggagcacgtttaattagactcattttagaaaagtgatcgttaattaccatcatgttatttaacagtagatgactaaatggatcatccgcgggaattacggagtatatgccaaaatctttaacaatatcttcgcttacaaaaaagtctttaggtttgaccggcttattaataagcatgtcgtcattaaacaagataaactgatcacttaatccttgaatcctatgaagattcaataaaataggattggaactaaacgtcggcaaccactgttctggtatatagtcttcgtgttgaaccttaactaacttttcattcgaatagtccaaccagtctggccattgattatcagtaatcaaaaaaaccttattcacccaaggggcgaaacggtcaattgaacgaaaaaggtatttcaaaagtccactgtcacgatatctatactggccattgagctgaccgctcatgacaccactagcttctcctttattttcgaataatcgcctcttctcaagcagtacaggatcggccccatctacccaagggatcacaatgtcaatcttcatatttccccctcaaaatatcttcgtattcatattaagactttgatcatctcttataattaatcattatagacaaaagtaaaaatattgtaaatctgatttacaatttttaaggttcgccaacaaaaagccaatgcccttataggatttctaaaactgccacaaagaaatcaagtgaaagagattgactttgaacgtctattatttattttgttactttctgtaagctaaaggtaagtgtctaatagtattggctacggaactagcctgtcatttttgttcggtactccatcatccgatacaaaatcataatagttttcgatccatctcgaacttcaattaaaattagcacaccaaaaacggccaagagaaggtcaaaattggccttcacaatcgcaaaggtataccgtacctacaaacactgagttcctccttctatacttgttctatcaagcagattggaggatttttatgtctcaaaccaacgacatggtgcccgttaagatggttaaccgcgatggcgcttctgttgtcgtcaaacccaaactaggagccaaagtaaaactggatgacgccgagcgtcagtgcccaaattgtaccgccgaaatgcgtgagatgggtgtcactgttaccagtcgtgaaccagttcgtattccggcatatgttgaagtccacatgcattatcaacacgcctatgaatgtcgccaatgttcagaccaacta

SEQ ID NO: 30 - DNA, 5382 bp, Lactobacillus rhamnosus
  misc_feature (1)...(5382): n = A,T,C or G
tcttattattagcaatgacccacacatccatgagcagctctgcaagaaagcccagagctcttttttcattgccttttagtttatcaaagttcagatttttttcaatgatacgcaatgtcgaaaaaagccacgaacaatagtcatcaaacgtctcacgtttcataataaacatgttaaacatgtgcgcagacgttcgtgataacacagtgttcagcgcgtcttggtatttttcaggaaattttgaaaaggatcttttcaaatgatcaattcttctgggtcatggctatggacgtaatgactttcaatcgtttcaatgtaatatctccgttttattggaagtacaacatcgcctttgctaagtaacgccagaacttcttttttcttgagcagatgactgaagtctttttttaatgtcttcttggaaacaaaatacctccgataatggttcaaaccaataacgtcagcatcggagttcttccacgcccagtatgtggctgttagttcgttaaagtgggaattctcagaggaaatattatcacccgtatcatcagattgaaaaccatctggaacattatgttttgaggcagccccaacaaaaatcggatcatatatctcatcattatttggcattttatattgcttatgactagctattaacatttgaaccttcatttgataccctcattttcacaaattgtcactttacttccgccacaacttcttgattatattgattcaaaaaaatatttggaatatcatgaactctgttgccatcttgagcttcattaacatatttatacgccactggcactttcctgtctgcattcattaacatccaagaatactctatatcaagatgcccaatatcaagaacttgtgcagacgttttgagatttacatcgtttgctaagattgtggcagtaggacccaaagagataagaattaatatatcaggatccttaagcttctcgacaatacgaacaataacatctaaaatttcatcgtatcgttcaaaagcattttcagaaggacagacaatccttttaattgatgcggcattcttcaaaagatcgtttccaataccaaatcgtgtctgagaaccctcaaccagcaaaacagttcgaccttgccatatttgtttgattagattaaagagctttggcccttggcttctatctttataaatcatatagggcctagtcagaagagagtctagatacgtttttcgaggatccaaagtacgaacccactgatagccatgatgtcctaattgtccggcccaaaagaatgcatcaagccgtctatattgtttcaatccggaaaaaatgtctggaatgcaaacttggaaccctctcctatcagttcgcacgacttccaaaagtgcggccgccaaagcgggagaattcttttcaaagttatcaggttctcgttctttaaacatccatttaaattcgccgtcaccaaacctactgatcgatactctttttctgataataatttggatcgactcttcgatcgaccgtactttaatctgttgatgcgtaaccagtaagtatagacgaaaaatagcataggctaacagctttacccatccaaaaattgacatcttaacttcacgtataaaactggtcttatttgtcaatctcattctccaccattttattgtttggatacttgatttcgggattaaagaaaaagccattccatgtaccaacaattgcagcttccaaacgacgtaatcgatggtcctgtgcagtgatgcaggtaagacctgtaaatacgttcgaaagaaccatcttggtaacatctttctttcgaccataaatgcgtttgacatagattaagttgcgatacattgatttgaagcgccaaatacgatccgcctgaatcgtcttcaagttatctgccattaaattgtaacctgttttatgaacaacaatgctttcactaacaaagaaactagttttagcggcagatagccttgttgtgtactcagtgtcatctccccaaatctgcatactgcctaacggaagacccagtcgcttgatgttgaccttagggactagaaccgaaacgaaagttgctgaaacaacgcccacaagtcccatatctatcttatcaggccaatccgtggaaacgtgcgcaatgtttgtagcgcgtccatcagtccacctgacattagaacagagaaatccaaaatcatcctctaataaactcgccttttctaacaaagctgcggaagcttctatatttggaattgtgtcatcgtccatgatccaaacatagtttccactcccttcacttgaggctttattcaccccgtattcaaatcctgcagccccgccgatattatcatgcagcgttgaggtcttaattagtggatctttaatatgttcaagatattcagtggtgccgtcagtgctgtaattattaatcacaaaaatggagcttaagttttctcgctgattcagtagcgctttaagacattcctttaaaagcggcagtcggttgtaagtgactaccaccgcatcaatcgagttttccatccaatccccccaaaactataccgattaaacgtcgatcatttattcctgaattcgattccgaaactttatcattgtatctattgtaaactttctcgcaaaaaaataatttgggtttgctaccaatgccagatcatctgaggttaaatatcgcggcgttagattatgctttgatttccacacaaaatcaacatacctaagatttgcagacaatgttcccatgaaccgagtatttgaaattaaactttgaatgaacaattcatcgcagcaatacgtataattgaaatgttttatgatccaattttcatgacccaatatataacgcgctaaatcgtccgtaatactaaaccactgtgatccagactgtactgtaatttttctagctctattgatgcctatatagcgttgaaagtaacagaaagaaaagtcgatgtacttaaaaatgttcctcttccgtcccacaaacttatcttgaagaaaatgatactgttgataccggagtcgatacctatcaggattttgtctttttaaacggtcacttacttcaagaaaatttgtccccttatttcgtctaaaaaactcattgatttcaagattggtttttagaggaaagtcttcacccgagagtaggtggtaatagtcgtattggccgcttgatgtagcggacttcaacaagcacagttcaattcttactaaagaaaatccccccaatttccttttatcctttcaacgaagcggattcttgaaaacttaacaacatttttgactttaagttcatcaaaggccccagcttttaagtcaatatgaataaaaaagtcgtgtctcgggtcgtcaagttattttaaaatctgcaatagcttatcgttgatctcactagccatgattaaaaatgcatgtttcacagtccctctcgccctttctccctacaacagcatttggcttgacagtctaacaaaaggctaaacaaattgttagacataacaaggaggaataaaacataatctcatatttaagcactccaaagttggaaccacctgtagacgaacaggatggcatttgtacctatacatgtaaaatcccaaccctctcggattttaacacgatctctgttacttttcctttaaaaaagttttgtttgttaaattacctaaggcctcttaaagatgaaatcatttgcaataaaatttttggacgaagtatgactaacgcaagcgtatatatcaaagctccatacattgttgcgcctaacaaagcgagaaagtttgacaacggtaatacattgataaaaactcgtacgctaactcccattaaaagcgcggcaaccaaatacttccatacttcactaaaaagcgacctgatccgaagttggtttctcaccttacttaactggtaaatagaaaccaataactccgatagaaccgttgcaatcatcgctccattgctgccccaaattaagatgaagggcacattcaataccatgttggcaacagccccaaaaacaacagatgtcgtaaacggtctaagctgattagttggtagtaagtattgaaccccagtagcattactgatgccaataagtacaataactatcgattcgatcactaataaattagcaaccgggtcgaagccctttccaaaaaagattttcgtgaatattggtgcgattccggctaacccagttgtcattggaaatgcgataacaagaatgaagtgcatagatttattcaatgatgcttcaacctcatcatgttttccttgtgcaaaactatgcgccgtgtgcggaagcaacactgtccccgtagctgtcacaactgcaagtaatattttgacgatcttgtctgagttatcatagaagcctgatgcctgaaccccaacaagggctcccagcattgtcttgttgacttgtagatatacttgtgtcgcaatctgcggaacaaacatttcgattgtcggacgtaaatgatcaatgactttcaaatcataccaatgcggcacaacaacgtatttttttaaatatggtactaatgttaggttccccagaacttgagaaccagtaagaattaggatgtagagccaaagatcgttctttgttcggacaaggacaaagatcagtatcagcgaaatgatcttaaccaaagtatttcttaacacggtaatacgaaattcttcaagaccctgaaaaagccaagatacatcaatcgctgtcgctaccagcaaaagtccttgaataagatagaagacttgatattctcctgacagcaatatgaagcccaaatatagcagcgtcgcaatgcctgtcgtaacaagccttaacaaggttaattcccaaaacaaacctgataaacgtttaggattgtcgcgctgataggctacttcgcgatttccatacattgttagccccaatgtcccaaatagaacaaaatactgaacaatcgaattcgtaaatgcattgatgccaattcctgtcggtccaagaactcgagaaacataaggaatagtaacaatcggaagtaaaagaatgaaaatttggtaccccatattccagaggagatttttgactattttagtgatgatccacttcatttcgacggagtatcgcagccaaatgaaaaagccaagtgatcactcacttgcttttgttgtaaaaaaagcttcgtttaagaaattgtaatggaagtgtgatttacttgatttggagtaatcatggnnntcnnttnggtggtgtttcantgttttcaatgtttntttatgtttcaatttttgacatataggtttttaattaaaaataattttatgttatattatttgatatgtggaattttgtatgagattattataa

SEQ ID NO: 31 - DNA, 3215 bp, Lactobacillus rhamnosus
gatcatgatggggcagcagtcgccatcaagcagtatgcaatgggtgaaggttaataaaaaagcgagtcgaattcctgataatggaagtcgactcgctttttattttagccgaaatagtttcgtttaaatctaatcttttaagtcaataattgcctgttccaactcctgtttctgagctgcagagatttccggatattttagcggcaaagcggtgacttcgcggttgatgatttgggacacaaccagtcgggagtaccacttatcgtctgacggaatcacgtaccagggatttgttttcgtggcggtgtgctgaatggcatcttgataagcttgctggtaatcatcccaaaagcgccgttcgtgaatatccgccaatgagaacttccaattcttttcgggaatttcgattcgttttaagaagcgatttttttgttcggccttggaaatgtgtaagaagaacttgagcagcaagatgccattgcggtgcgcataggtttctagcgccttgatatcgttgaagcgtttggcccataaatcgtcatggacatcagcaacggtgttgattcccggcaggttttcttttaatagcaattcgggatgaacccggtcgaccagcacttcttcataatgggagcgattgaacaccgtcagttcgccaccagccgggaaagcgttatggatgcgccataaaaagtcatggcctagttcaagctcagtcggtactttaaacgacaccactgaggttccctgcggattgacgccggacatgacgtgttcaatcatgctgtctttgccggctgcatccatcccttgaaagataatcaagacgctgtattgtttctgtgccgccaagtgttgctgaactttggagagcaccttgatgttatgatcaatgtctgctttgatctgctcttttttattttgaaaatgttctggcggcgcggtcgcaaacgcttgaatgttaaaggtgccagtgccgtcaaaacgatatttttccaatgtcatcttatcaccttcaatttaagcttagtttcaacatagtagttacgccaaggatgtgcaagcaattgacgccttggcggattaaatctatgctgagattacgacatgaaaacggaggcaattgcatgacattaccaagaattcaagatgatttgtacctagccgtcaatggcgaatggcaagcgaagacgccgattccacctgacaaaagtgttgtgagtgcggatagtaatctgaccgatgatattcgccaaaaactagtggctgatctaagcacgatgacgaaaacagccaaaactttgccgctccagtatgcagcgcggttgtttgccaaagccaatgaccaaacccgccgtcagcagctaggcattgagccagttcgtgatcggataagctttttgatggcgctcacgacgcttgatcaatttcgcagcgctatgcccaaactggttgctgatcaatacgtcttaccgatcagtccttacgttgatgctgatatgcacgatgccgagcataatattctgaatcttggcgggccagacacaattttacctgatgcggcgatgtaccaacatgaagatgccgaaaatgcggcggatctggcagcgtggtcgcagatggcagctgccatgctggctgcggtaggattcagtcagactgatcaaacagcatatgttgaagcggctaaacgatttgatcggcgtttggctgattatgtgccagcaaatgttgacttagcggtagatagcacgtatgacaatccattgagctggcaggcgtttgaagatgcggccggttatttggggatcccacaagcctttgcaacttacatgccgcaaacaccggcgaaagtcaatgcggttgtaccggcttatcttccgcacttaagcaaactactgacgccggacaattattcagaatggcacgcatggatggtgattaacgaattgctaacctgcgccacttacctcagtgatgatttacgtcaattggccggacagtatgatcggtttttggctggtcaacctgaggcgtcatcgtggacgaaacacgcttttgggattgccaacgagtattttgacgatgtgattggtcagtattatggtcaaacctactttggtgccgacgctaaggcagatgtgacggccatggttaagcaaattcttgcgcaataccgcgtgcagctagaaaacaacacttggctgagtccggctacgaagcaaaaggcgatgcgcaagttagccacgatgcaagtcaaaatggggtatccggagcgactcttttccttgtatgatcacttgagcgtggatgttgacgatgatttgttgacggcaattctgaaacttagcgcacagacgcaggccttttggtttaaacagttaggccagacggtggatcggaatcaatggaatatgccgggacacttggtgaatgccagttatgatccgctgaaaaatgacatcacttttcccgctggtatcttgcagccgccgtattactcactcaaatggacccgggcggaaaacctcggagggacaggcgcaacgatcggtcatgaaatctcgcattcgtttgataataacggggcgctgtatgatgaatatggtaatttgcataactggtggacaccagcggataagcaggcatttgatcagctggtaaaagcgatggcggcacagtttgatggccgtgactatgaaggagtcaaggtcaacggtacactgaccgttagtgaaaacatggcggataacgccggcatggatgtggcgttggcgttactaggcgatcagccggatgttaaggatctgcaggcattcttcatcacttacgctcgttcatgggccaccaaaatgcgaccggagcgggctaaaactgttttgcggcaagatgttcatgcgccggctaccttacgcgtgaatgtgccggtgcaaaactttcctgcatggtaccaggcatttaatgttcagccacaagatggtatgtatcggcaaccacagaagcggctgacgatttggcatcagtaatatttaaataaaagagttttatgtgaacctttttcgagaaccgcgagatcaactgtgtgtcacactgttcatggggaagcgtaaacaaaaaggcaacgattgccgtgagacaatcgttgccttttttcaatcttgggacaggtcgtggtaataatgtagccagccggtttcgcgttcgccgatttgatc

SEQ ID NO: 32 - DNA, 1504 bp, Lactobacillus rhamnosus
ttggtgttactggtgcacttgttcaggtaaatcattttagcttaaatcaaaatgttcaaatgtaataatgctccaatgcagtaaacaaaaattcaacctgtcacttttttaacacgcactccagcttgagaaccttttgataagcactttgttcacgatgagcaacgttcagataactaccatgaacaaacttgactatccactggcatcggctggagaattcaagttcatattttgggaggaatcgttatggtggagttacaatcagttaaagatgaatcaccgttaagtcgcgcgttacaagacgagcactataacggcgctgtcgcagttgtttcacccgataaggaattagcggcggattcacaaggcttttcacacattgatatggcagtaccgtttgcctcacatacggtcagcggagccggaacagtcacacaacaattcttcggcattttactcatgcaattcgttgaaaagggagtcgtcaagcttagcgataaactgtctcaatatgttcctgagtatcacaatgccgaccagatcactttgcaccagctagcgaacatgcaaagcggtatccctgactaccttactttgatggcaaagcccttcaaggagaacgcacctgccaccttgccagatgaacggttagctttacaaattgatcagcacaatgctactaatatggatttcgctaaggttctggatgttgtcaatgacgtgccactcgcttttaagccaggcagccaaacttcttatagcagcaccaatgcgattttaataggcgaagttcttgatcgactgacgaatgaacgcccactcgaagcagttttgaaggaatacatctatgatccactagcactgaccaacactaaacttggcaccgcgcacgcatttgcggaaggttatcactggattgccggcaatccaaacattgcaggaaaaggtgatgaaaatcaggccgatcgcggacttgttacaaccgttgatgatctcgaaaagttcgcacaagctgttttgactggtaaactgctacaatcaaccagctggaaaactatcttcaaagatgccgagaatggctatggatttggttggcataaattagaaaacggctggctaggtaactctggcagcatgcttggatatactggtctgctaagtatcaaccaaaagcagaaaaaagctgtcgtcggtttaacgaatgtcttaaaaccgcagccggccatggatcagttctttaatacgatttatcaagttgcgacaactttatagttttcaaacagaaagaagccttgattgcgtttacggatgcaatcagggcttcttgacttttattgtcgtcgggaggagactggcaacgaattaaatttacactgggataggagtcgttatgacattttggatttttatctacttaattgttgccggtatttttggcggtttattagcttccattgctggattggcctcacttgtttcatatcctgcttgctctttgatc

SEQ ID NO: 33 - DNA, 2726 bp, Lactobacillus rhamnosus
aggttatcgttcctgtgaccctctcgattaaacaaacaggaccggcaaattatggtcataaaaaggacaaccctaattacatcgaaaacatgtggttgaacatcccttatagcatgagcagccaaaccgataccattttcgataaaaacaaactcagggttaaaccagcgatgcatccttcaaccgtgcgccaaccattaaccttgcagttctcagcaactcggacaagttatgatcatcgcaaccaaaaaatgcgcttcagcttcctcgtgcccgttaagaattatcttgtgaagtattcgttgttgctggaatgatgcggctgattagcgttgagtacgtctaaagcaattctacaaaggctgtaatcattgcaaaattcccccggtttcttcccttcccccagaagcgtagaatggcgttatacatggagaagcgtaaaaactagaaatggggaacagacatgaagaaatcgacgcgcaccatcctgattagtgtggtcgcagcaattgtcgtcattgtgggtggcttcggtgcctttcactggtaccaaggcaaagctgaaggcgaccaggttaaggccacggcccaagcctacacgaaagcttttgccaaccgccagtatgaaaaagccgttaaacaagtcgacactagccatctcaaaggtccgggctggcaatataccgccaagacgttggctgaacgcaatcaggccgttttcgaccggatcggcgccagcaacattaaaatcacggatctgaaaacaaccaattccaaagacggtacctatcaactcacttttaccgccaacatgaacaccaagatcggcaagctcccggcacagcattacaccgcgccgatcgttaaagtcggcgacaactggcgcattcgctggacgccaagcctgctgtttccacaaatggatggcaaggacacggttcagattagtttgacagctgccacgcgcgggaaaattctcgatcgtaatggccaggcgctcgccaccaacggcaatgtcacccaagccggcctggtccctggcaagctgggcaccggcgatgaacggaccgctaatctagaaaaaatcgcgactgcctgggatgtgaaaacctcgagtcttgaaacgctcctcaagcaatcctgggtcaccgatgatacatttgtgccggtcaaaatcgtcaccgactcccctgcattaaccggtgcagcttaccaaacaatcggttcacgtacttatccgctaggcgaggccgctgctcaactcgtgggatacgttggtacggcaaccgccgatgaccttaaaaagcatccgtcactgaccgccaacagcaaaatcggtaaagccggtttggaacaaatttatgaccattacttgcgcggtacggatggcggcacgatcgcgattcgcaacggcagcaatagtcatcccttgctagacaccaagccaattgccggcaagaatctgaaactgacgattgacgccaccaaacaaaaaaccgcttatacccaactagcaggtaaaagcggcagtgtggtcactatggatccaaccaacggcgaacttttaactttagcaagttcgcccagctacgatcccaatgccttcgtgaacggcatcagccaaaccaactatgacaaatacgccaacaacactgagctgccattcctcagccggttcacccaacgatacgcaccgggttccacttttaaaatgctaacggctgcgattgccctgcaaaacaaaaccatcacccctgacacaaccaaatctatctccggtctcaaatggcaaaaagatagttcgtggggcgactacaaagtgacccgcaccgttgacgccagcccggaaaacatgacccaggccttggttaactccgacaacatctggtttgctcaagtagcactgaaaatgggcgcctctgcttacctcaaaggtctggagccccttttcaaaacccaagccaacttacctttaaccatgaaaaaggcccaaatctccaacaatggcaagctcgcctccgaaacgctcttggccgacaccgcttatggtcaagggcagctgctgctatcgccaattgaacaggcggcgatgtacagtgccatcgccaatgacggcaccatgcagcagccaaccttgattcaagctgcaaaaggcaaacgtaccagcgtgctccaaagcaatgctgccaaaacggtcaaaaccgccttgacccacgttgtctccgatcacccaattgacattcaagtcttgggtattggccgcaatggtcacattggcttcaacgaaccaggctcaccatttgatgccgaaacccggaaagtacctttaacccaaagcaccattgacgccaacgcccgcttctttgaaaacgaaaacgacgtaccgcgctatgcttactccatgggtattggctccatcatgaagagcaaaaagatcttgcttttggcatttggcgaaaataaggccgatgcggttcaaaagatgatcgaaggccctgttaccaacgacgtgccagcatctattttgcaaaagcatccagatgttgtcgttatcttggacaaggctgccgcaagtaagttaagccacaaataatcagccattcagcaccatttaatggcgtgagcggccacattagtttgcgcaggtgaacattaaaaattcgaccctggagaattttatctggggtcgaattttgtttctgcttcattataggaagttgctgatc

SEQ ID NO: 34 - DNA, 1592 bp, Lactobacillus rhamnosus
aattctcaaggaggaactcatttgaagtttaaagaactaggtttggatcatgatctcttaaaggcaatcgcccagtcaggttttgaggaagcgacgccgattcaagcggagacgatcccactggttctggaaggcaaagatgtgatcggtcaagcccagaccggtaccgggaaaacggcagcatttggcttgccaattctgcaacacatcgataaagccgaccggagtatccaagcattggtcatttccccaactcgggaattggcgattcagacccaagaagagctttaccgtttaggccgcgacaagaagatcaaggttcaggctgtctatggcggcgctgatattcgccgccagattcgtcagcttgctgaccatccgcaaattgtggttgggacacctggtcggattcttgatcatattggtcgtcataccttaaagttggaacaccttgataccttggtgttagatgaagccgatgaaatgctcgatatgggcttcattgacgatattgaaaagattgttgaacaaatgccgaccgagcgtcaaacattactgttctccgcgacgatgccggcagcgatcatgcgcttaaccaacaagttcatgaaagaacctgtgattgtcaagattaaggctaaggaactgacagcagataccgttgagcaatattatgttcgggccaaggactatgaaaagttcgatgtcatgacacgactgtttgacgttcaggatccggacttggcactgatttttggacggaccaagcgtcgtgttgacgaactgacacggggattaaaggcacgcggctatcgggctgaaggtattcacggcgatttaacccagcaaaagcgaatgagcgttttgcggcagttcaagagcggccaattggattttctggttgcaaccgatgtcgctgctcgtgggttggacatttctggtgtcacccatgtttacaaccttgatatcccgcaagatccggattcctatgttcaccgtatcggtcggacgggacgcgccggacataaaggggtatccgtaacctttgtcacgccaaatgaaattgaatatctgcacaccattgaagatctcaccaagaagcggatgttaccgatgaagccgccgacagctgaagaagcattaatgggccagatctccagcggcttagcaaccatcaaggaacaagttgaagctaacgataccgaaaagtatgaagcaatggctgaaaccttgttggaaaactacaccccgttgcagctggtttcggcgtatctcaaggcagtcagccctgacgatgcgagtgccgttccggttaaaattacaccagaacgtccattaccacgccgcggccgcaacaatcacggccatggcaacaatcgtggcggttataaaggcggctacaaaggcaagcgacgcgatggcggctatcaaggtaatcgcgatggcaagcgcagttacgacaagaagcgcaactttggcgacaaacgtaaaaacgttaagcgtaatttcaaaatccgtacgggtgaataatcaccagtacgttaatagaccggtcattcatgcgaatcaatgaccagtgctgaaaagcgatc

SEQ ID NO: 35 - DNA, 196 bp, Lactobacillus rhamnosus
caaccgatgtggcggcaaccagtgaagccgatgttgtgtttcataatggtttgaaccttgaaaccggtggtaatggctggttcaagaagttggttaagacgtcacacaaagaatttgataaggatgttttcgctgcaagtaaaggcgtgaccgcccaacacttaacaacgaacaccaaggaacaggatccactagt

SEQ ID NO: 36 - DNA, 1449 bp, Lactobacillus rhamnosus
agataacatgacgactttgatttttggacatcaaaaccctgatacagacgcgattacaagcgccatgagttgggctgaatttcagaagcaagcaggtaataccgatgttgaagcagtagcactcggtgaaccaaacgatgaaaccaagtttgtattggatcattttaaggttgctgcgccgcgggtcattaagacagccgcaaatgaaaccgggcacgtaatgttggttgatcataacgaattccagcaaagcgttgctgatatcgaagacgtgcaaatcgattcagtggttgatcaccaccgcattgccaacttccatacggcgtcaccactatattaccgggcagaaccagtgggcagtaccaacacggtgattttcgagttgttccaggaacacggctatgaaatttcaccaacactggcaggcttaatggcttctggcttgatttcggataccctgcttctgaagtcaccgactgcaaccgacaaggacaaaaagatcttgccggaaatggctaaaatcgctggcattgacctgcaatcatacggtttggctatgttgaaggcgggcaccaatctagctgccaagtcggatatggatatcattgaaggcgatgcgaagagctttacgatgggcggtaagtctatccgtattggacaagtgaatacagttgatcttgatgatatttatgcgcgtcaggatgaattggtggccgctatgaccaaagaagcacaggcgaagggctatgatgacttcctgttaattgcaaccgatattctgaacagcaattcagcgggctttgctgttggcgcagatcgtgacaaagtggccgcagcattcaacgaaaagtttgatgccaatgaccggttggcactgcctggcgtggtttcacgtaagaagcaggtcgtaccgccaatgcaaggtgcgtttgaaggttaattttgaacttaataattggttttataaatcgcagccgtttgtggttgcgatttttttgtgctcaaaaacttggaagaacaaaaaagtcgaatttttagatctgaaggtgcagaaatgtgattattgcgaaatttttcagtaagaatagttcaaatttaaaacgaggtgcaaaaaacgcagccttataactacttcgtataatatatattatgtaaactagaatggagattttgagtcgttgactttgacgtgacttatttggtgttcaaatggcaaaacgattgatgcaagtcccctcacctgacagacagctcaaaaacttttgagagaagcaaatcaattgtacggatgtgagcggtgcgctttatttgtttttttctggtttgaaaatgaccagtcgttgctaaatatatgtaaattcagcattaatcaaagcagatttgtagaaagtatcattttgagtcataaacagcattcaagtcgcaagtgttgctgtcagctgaattctg

SEQ ID NO: 37 - DNA, 1349 bp, Lactobacillus rhamnosus
ccataaacgatgataatttcccaaccaacttaatgaacgttcaatgagccaccgttgggggataaccgaaaattggtgtaactcatttctttaacgacgattaccttggctgaggttaaactgctaatctcattggcaaaattttggccggtataaccactatcaaccatcatggttcgaaccaatttaaactgctctaaattaagggtgacgagtgcaatcgccccgtcacgatcagtgatgttagcccgggtaatatggatagcttgggggaatccattgatgtcaacggctaaatggcgcttaatgccggaaattttcttgccaccatcgtaacccttattttcagcggtagcggtgttcttaatgctttgggcatctaaaatgacgaacgaagttcgggctgaccgcccttgccttaatcgtcgatcagcgacaatttttttaaaacctgagttaataaagctggtttatcaggggtgggggcttttgaccaactcatccaatagtagtaaacggtggaccactttggataatcagccggcaaatcacgccaagtacagccatttttaaggacatagagcatggcacagaagatatcataaggatcaatgtgttttgggtgagttcgttttcttgaagcttccagatcctgacggatcaaatccaattgttgccgagaaatatcgctttggtaatgatgactaaaatgttgcatatgatcaccaacttttttgacagtagtttatcaaattattgggtcaaaatcaaagatactaaacagcttcttaagagattttagacagcttctaagggatatcaattagcagatacggtaatcgtaacttctacaaattttgattaaaaaggggccgttattaaaattatcgataagattgagaaaacctcagtttcagggacgaagacttggagggataacaacaatcaagatggaatccgtccaagttcaatcacggtaaactcattggccaatggtcaacaagttgcaagcaagaaagttactgccagtgataactggcagtacagtttcgacaacttagctgcttatgctaatggtcagaagattacctacacagttacggaagatgcagttgcggggtacaccagtactgttgatggttacaatattactaatacccataatccgacaacgcctaagaagccccaggttcctaataacccgacaacgcctaaggaacctcaagttcctaataatgggaataaggtaacaccaaaggatttcactcaaggtaaaatgtacgataaaacaagtagattacctcaaacaggtgatggatcatcaatgggtatgatgttaattggactag

SEQ ID NO: 38 - DNA, 412 bp, Lactobacillus rhamnosus
atcggctttggtatgggtgcgataatccatttaaggtgtttttgccttcaacctggatccatttctttaacttcttacgttaggagtggacatgaaacaaatcctgacttggctggtgcggggctaccagcgatttatttccccgttatttccgccgagttgtcggtattatccgacttgttcgacgtatatgattcaggcattgcaacgacatggggcggtaaaaggatttttaatggggattgctcggattttacgatgcaacccctttgttaaaggtgggctagatccggtgccagcttattttacgttgcggcgtaatccgcatcccgaaaatgatttggatcttagtgacattcaaaatcttaatcgcaagctaggaggccatcatggctaaagaaaaaaatattaa

SEQ ID NO: 39 - DNA, 1836 bp, Lactobacillus rhamnosus
gatcaaccttatcagcatacaggccaccctttgagcgataatccggaatccccgaagccgttgacacccctgctccggtcataaacgtcacatacttagccggagtcactgccgtctgtaaatcaaacattagccatccctccgtcgttatctcttcctatcaccaatatagcaagcatcccaaccagtattatttaattgccgtcaacgtttccccttgacaagtcgtttcaagtccatgacagcgcattcagccgtcaaaaataattttgtatttcttaacattctacggtcgaaaggtgtaatattattctatataaagattgatagaaaggagtcttgattgtcatgaaatcctttcggtggtcgcacttctttagttatttgattatggccattgttttagttttctttgccattgttctttaccaggtagtcatgcttggtattcaatccgtcactaacggcttctttattaatttcggtcatcattaacggattgtataatccagttggtactgcgccagaacgtcattcagcggttgttgatacagctgctggaaggcttctggcgttgttgcgttctcggacagcggcaagacgaatgcattttggtcatcacttcgacccatggcaacataagcaggctgcttagtctcccgatcgcggtagccactgtgcttgattaggtaaacctgatccaaggtgagtcgcaattgccgtttggataaaaccggtgacaacgtagcgaattcctgatcacactgcagttaaggcgccttatgtccggttaattaccaccgaaaaaggcccgaatggcgatgaaatttctaactatgatttacgcttggttcagccaaacaccgctgcgattgatactgccgggttgcatacaattgaacacttgttggcatcgttattgcgcgatcgcatggatggcgtgattgattgttcaccgtttggctgccgcaccggctttcactttgattacctggggaacacacagcaccacggaagtcgccaaagcgctgaagtccagccttgaagcgattgctaacgatattacctgggatgatgtacccggtgttgacatcaagagttgtggcaactacaaagatcacagcctgttttctgctaaagagtgggcaaagttgattttgagtcgcggcatttctaacgatccatttacccggcaggttgtctaatctgacgagcattgattagaaccaaaaatggcactgcacaagttcgaatagcgaacctggcagcgccattttcatgtcaccatgtttaactgaatagatcaatcaaccaccggccaccatatagcaaactcatgctataggcgaagatggtaatgggtttgccgagtataataatccagaagaacctggtaaaggtcattttggtgagaccggcgagcaaacatagcacatcatctggggcaaccggcaacacaatagcaagggtaaacaggtgatcaaagcgggtctgattcttagtgtagccgatgtatttttcataagttttttccgaaattaaatacggtcagcaggggcttgccaaaacggcgggcaagaaaaaagttaataaaagatccgatcgcgatgccgatgtagttgtagagaaaaccaaaccacgggccaaaaagaatcacacccgcagcggtactgatgccgcctggaatgatgggaatcacgacctggatgacttggatgacaacgaaaaataaagctccggttaagccgagtcgggcaatgtaactttgtaaaaccttgacatcagaaagaatccctagatcgcaccaataaatagtgacgacgactaaagcgatcc

SEQ ID NO: 40 - DNA, 1412 bp, Lactobacillus rhamnosus
catatggagcggatgcggttaagttaaaggtgacattgccggttttagtatcgactttaccggagaagactttaccactcatggcatcggtcgcgtatacgatcagcaggtgccggttggcgttgccatggtggtggcggtcaatgcgaccacggtagagttgaagaatctcgcggtcacgcctgcccgccgccgtcaagggattgcatcaggattattgcggcatgtcagtttggtgtacgccgagaaatatcaggatatgctggtgggtaccggagatgctgattttgataatcttaggttttatatgcgccgcgggtttcgatttgattcgattcggaagcatttttttgatgaatatagtcagccggtttatgctgatggcttgcgattacaggacatgatcgtgttacgccgcaaattgttgttgacgcgtgaggataagacaaaggagtaaggctattggcgaaaaagcgccgacgttttaccttaaagaaggttccattggcggcttggctggtcatcgctttttttgcggttggttcaatgttggttgtcagctcgtattggtcgcaacggcaagccgaagtttcacaacgccaagcaattgtcgataagaaggcggctgaaaaagcgaagaaagaggcttttatcaagcgattggtaccgacagcccaggccatgcagaaacagtatggcgtcttgacgagcattacgctggcccaggcgattcttgagtctgattggggaacaagcacgttagccaaggattaccataacttatttggcattaaggggacggatcctgccaccacgaaagtattacggacgaaggaatacgttaatgacaaatggatcacggttgacggccggtttcgggtttatagcgatgatgctgcttcgattcgggatcatgccttgctattcgttaacggtaccgactggaatccgcagcagtatgcaacggtgcgggccgcaaaagattataagactgccgcctcggctttgcagacggatgggtatgctactgatccggattatccccagaagctgattcatttgatcgaagcatggaatctgacccagtatgacaattgaatgttcgtattttgttgattattgaatcctcgttatttggttatggtagcgccaaattgcgggggtttcgttcttttatcgctgtgaaagcggctacttagtttgttcgggaattagtgagcttgtattgttccacggcgttttttatggtaagctgattgaaaatttacaaataaaaggagtgcttgtggtgaaattactggaagaccggattaaaaaagatggccaagttattggaacagacgtattgaaggtggacaactttttgaatcatcaagttgatcctgatttaatggctgatcttggtaaggaat

SEQ ID NO: 41 - DNA, 1914 bp, Lactobacillus rhamnosus
gctgcacttgaatttgtacatacctattctttgattcatgacgatttgcctgctatggataatgatgatctccgccgcggtcagccgacgaatcacaaacagtttggcgaggcgctcgcgattttggctggggatgcattgttaaccgacgcattcgctatcttaagccagcactatccgggaaaaggtgccgaactcgttcaaattctggcagaagcggctggcagttcaggaatggttgcaggccaggtacttgatatggatggcgagcaaacgcaatatgacctagcaactctcaaacagatgcatcaggctaaaaccggcgcgctgatccaggccggtgtggcaatgggtagtttgtttgtcgcgattcccgaagccgatcaagctgccttagccgattttgcggctgcttttggtctgggttttcaaatcaaagatgatatcaatgatgtgactaaaaccaccgcggaattaggtaagactgccgataaggatgtggccgaacacaaaaatacatttcccgaactgctgggattagccggtgccaaacaagcattggcgacccagtttcagctagccactgctgcgttaaacagcctgaccgttgatgcagccgacttaaaatcgattttggcggtgttacaagcatgacaaaggtaaaaaaagaacgggtcgatgtactgcttgtggagcaaggcttatttgagtcacgcgaacaggccaagcgttcggtgatggctggcgaagtctatgatcagaacaatcaacgtttggataagccgggggtcaaaatccccggcgatgccattttgcatgtgaaaggcaaaaaaatgccgtatgtaagtcgtggtgggcttaaattggctaaagcactgaaagtatttgcgattgatttgacgggtaaaaccgtgcttgacattggcgcatcaactggcggtttcaccgatgtggccttacaaaatggtgccaaaatgagctatgccttggatgtcggctataatcaactggcttggaaacttcgtgaggatccgcgcgtgaaagtgatggaacgggtgaattttcgttatagcaagcctgaagattttaccgatggccccgtggaatttgccatgacggatgttagttttatttcgttgaaactcattttgccgccgctaaaagccatcttaatgccgcacggtcacgcggtggcactcattaagccgcaatttgaagccgggcctgcgcatgttggtaagcatggcattgtccgcgatccccaggttcatcgggatgtgttgaagatgatcgttaactttgccagcgccaccggctataacgttttaggtttggcgtatagcccgatcaaaggcggcgaaggcaatattgaatttttaattcatttgcaaaatgctgaccaaacccctggagaaatcgcaccaactgttgatatcgagcgaacccttagtgatgcgtatgctgcattaaaacgcccttaattgaatatttatgcaaaaatttggtaagcctggtgcgtctgcgctatgctatgggtaaagcatttttccacgttaaaaatgcattcatgacagaggtgagcacatgcgaaagcgcgaacgacaagcgacaattcaacggttaattcaaagtgagccgatagaacggcaggaagatttggtggcccgtttgaccgagatgaaaattccggtcactcaggcaacgatttcccgggatattaaggaaatgcaactggtcaagattccggcaggtgagggacactatcgctacagtatgcccgcggaaaagcagctgcccgctacggataaactgcggcggacattggttaccgcgatgaagtggggcgaagcaatggataattttgtccatttggcgcttttgccagggacggcagccgcggttgagacgttgatc

SEQ ID NO: 42 - DNA, 1469 bp, Lactobacillus rhamnosus
acctttgccggtttctttgcctcggcttcagcggcgacgacattagccgataaggtcgctccgatttttgggtcctggtcgtttgcacacgaagcagcagtgattttagtgacgttgattttgtcgtatttctcgcttgttttcggggaactttatcctaagcaggtggcgcttcagatgacggaacgggttgccaagatcagcgtcaccccgattagttggctggcaacgttaatgcgcccgtttgtctggctattatccgcctcgactaaattgctgatgaagctgacccccatggagtttagtcatgaaggcgagtccgttacccgtgaagagatggttgctatgattgaaaatgggcgcaatgccggcgcaattgaaccggacgagtaccaaatgtttgaaggcatcatctctttgtctgatacgatggcacgtgaagtcatggtgccgcgtacggatgcgttcatgatcgatgccaaggaaccggatcaaagcgctattgatgcaattttgaataacatttattcgcgaattccagtttatgaagaagacaaagatcacgttattgggatcgttcatattaaaaatctgctcaaagaagcccggcgtgttggctttgagcaggttaagatcgaatcggtgatgaccgagccggtgtttgttccggagacgatccccgttgacgtgttgttgactgaaatgcaaaccaagcaacaacagatggccattcttttggatgagtatggcggggtcgttggcattgtcacgattgaagacttgttggaagaaattgtcggcgatattgatgatgaatccgaccaggctgagaagctatacacgaaacaaactgaccacgacttcattgtttcgggacggatgccgatttcggaatttaatgagctgtttaaaactaacttagatgcaccggatgttgacacgattgccggttatgtgctcactcaacttggggccattccttcgacccatcatagtgagaggcttgagctggctccaggggtgcagcttgccactggtaaagtcgaaggttctcggctggtcaatgtgcatattcatttaagtgagacgccacctttagaagttgtttccaaggaggcggatagttagcgatgccagcattgagagttaaaggtatgttggcagtcgtagtgttatttttggaaggaaacagattatgaaaccacaagaacgagcacaagaagtagcaaaacggcgaacgtttgcgattatctcacatccggatgccgggaaaaccaccattacggaacaactgttgttatttggcggcgtcatccgccaagccggtaccgttaaaggacggaaatccggtcattttgccaaatctgactggatggaaattgaaaagaaacgtgggatttccgtcaccagttccgtcatgcaatttaattatcaaggtaagcgcatcgatattttggatacgccggggc

SEQ ID NO: 43 - DNA, 681 bp, Lactobacillus rhamnosus
tttatccgaccttggttttaggtggcaccttgaaggctttaccaaaagaagtcaccgataactttaaagaattatttgcgacgttgccaaaattgggcttgaacgaatgggtatcaaccccttcttttgtcgaaattgcgttacttgatcgagttcctgatttaagcgatgctgtggttgcaagcctgccatcttccccacccattacaaatgttcatcaggaggtaaacaatgcgcgtgtcaaaatcaagtcattatgaatttaacaatgaaatgtttagcgccatcacccatgcgtttgcacttggcttagccgtaaccggcaccattgcgttaggcattaaaggcgtcaatagcggcagtcaagtcgaacttttcagtcttatcggttttggcgtttcgctcatgttgctttacaccgcctcgactgcttttcatggtttttattttagcaaggcgcgccatgttttgcaggtactcgatcactcaggcgtcttcattctgattgccggctcctacctgccatattgtttggtcgctattggcgggaaacttggcatcggtctattaatcgccatctgggcattgtgtctcggcggcattgcctacaaacttttcttcctgaatcgcttcaagcatctggaaacgatgatctacgtggtcctcggctggctttgctta

SEQ ID NO: 44 - DNA, 3279 bp, Lactobacillus rhamnosus
attcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaaggtaaacagtcaaaaagccctaaaccccccaagaaattatggcggcggattttaaaatggaccttgctcggcttgcttctcattttcattgccggtgtcgggttattctcctggtatgcaaaagatgcacctgaagtcacccaagcaaaactcgaatctggcggatccagtacgatttatgatcgtagcggtaatgagattacaacgcttggactggaaaatcgcgactatgtcaaagcttccgagattccgcaacaacttaaagatgcggttgtttcaattgaggaccgccgcttttacgatgagaaattgggcattgatcctgtccgtattctcggtgctgcttttaacaacatgaccggaaccggtgatggcttgcagggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatttgagtcttgcacaaacggctttcattgccggcctgccgcaaagtccggctggctacgacccttatgagtacccgcaaaaagcgactcagcggcgtaatgcagtcattgatgccatgttacgcgataagaaaattacggccgctgccgccaagcaagctaaagccacaccgattactgatggtttacagccaaaacaacaacagacaaacacaaccaccaatgataaagtgattgattcttacttgacgcaggtgattgcagaagttaagaagaaaaccggtttgaatccttacacggacaatctggatatttacaccaatattgacatgagtgcccaaaaacggctctacgatatcgtcaataccgatgattatgtcagtttcccggatgatgccttccagaccggcgtcacgatgacagatccggataacggacaggtcttagcgcaaattggcggccgtaaaaccggcgatgtgcggttagcatacaaccgggcagcgcaaaatacccgtagtaatggatcgacaatgaagccgctcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgaacagtcccgcaacattccagccgtcaaaaccttgagtgcagttggtatgacgaatgccgtgaagttcttaaagggactgggtatcgacttacctgcctcagaacaatatctttccagtgcgatcggggcatcggtcaacacggttgaagaagccggagcgtatggagcctttgctaatggcggcacttattacaagccttattacgtcaataaagtcgttagcgccgatggcaacacccaaacatttaacagtcaaggaacccgggcaatgaagtccagtaccgcctatatgatcacggatatgctaaaaggcgtgttgacaaaagggacaggaacctcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccatttcccagaagatctataaggcactgatgagttatacctcccagaaccttgataataaggattggacaaagccggatacagttgagtcgtacaatattctaaaaggcagcaatcccggcacagcgattacgagtggctcagccaacaccacgaaggagttgtacgttcgtggtcatggaccaagcagtcataaagcagtggctgaatcatcatcttcttccagtgccagctctgaatccagttcctcaaaagaatccagctcagaaagttcaaatgctgtttccgccagcatcgcgtcacatgcgacatcttccagtgtttcttctactgcgcctagttccgcagcaccttcaaaagaagaaacaagttccagcagtgagcctgtctcatctgctggtggtcctggtggtaatcaataagatttattcacgtgatttgaccatcaagagttttccctgatgaggattgccggacatcattaaaaaagcaccgctaccgatttgagatggtcagtagcggtgctttttatatgtgaaactaagcttgctgttctagatgaaccacggccacatggtgctgtgccaataacgtttcgccatacggatcattgcgatagtcatgcgcatacacaacacgcttaatgccagcctggatcaaggcctttgtacaattcaaacatgggaaaaagttaacgtagacggttgcgccatgggtactgaccccattagccgcacattgaatgatggcattcatttcggcatgtatggtccgaatgcagtgaccatcacgcattaaatgaccggcctcatcacaatgcggatcaccactaatcgcgccgttataaccggtcgcaatgatccgatgttcctgaaccaaaactgcccccaccgttgcgcgctcacaagttgaacgttctgaaacctttttggcgagttcaagaaaataatgatcccagctttcacggtgaaccgtacgcttggatggcataatggcatctgtcaatgttcttccccctttaatggcgcgtaatgggtagccagaaacgtccattccggtccggatggtggctgtgggtctcgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactaacatgagtatcaactgccacgcccggtatgccaaaagcatcgctgaggaccacagtggcgggtt

SEQ ID NO: 45 - DNA, 1152 bp, Lactobacillus rhamnosus
aacaaaaatggcgataagcctgattatgtcaccaacaaagctaaaacggccaaaatactgagtcgttatttggcgattggtgaagataaagttttagcacgtttaaatccaagtaagaatcttttccaagtcgagtttggtcggccagggacgaaattaagtttggcgatcaaaaaacaaatcgaagctgagaaattgccggggattcattttcgcgaaaccccatcgcggctttatcctaatggtgtgtttgccagtcatgtgattgggttggcacaagcgcaggataatggcggcggtttgaccggggtgatggggttagagaaacaatttaacaccgttttaaccggcaccaatggctatcggcgaagtgaaacagatgcatatggatataaactgcctaatgccaagaccaaagccaaggccccagtgaatggcggcagtgtctatacaacgcttgatagtggcctccaagcttatttggaaactcttatgacagatgttcaaaccaaatatgagcctaaaggcatgacggcggttttgatgaatgccaagaccggacgtattttagctgccacacagcgtccgacgtttgatgcttcgactggcgaaggattaggcgatatgtggcgggattctttggttgaggataattatgagccgggatcggtaatgaagatcatgaccttggctgctgctattcaaagcggtaagtatcaccccaatgaatatttccagtccggatcggttaagcttgatggcggcacggttaacgattggcggacaggcggctggggatccattccgctgagcaaagcgtttccgttatcgagtaatgtcggcatggttaagatcgaacaggaaatgggtgccggcatttggaagagttatttggataaatttaaatttggccaaaaaaccggcattacgttaccgggagaaacaagtggccggattagttttcaacgcccattggatcaggctatcaccgcctttggtcaaggcattgaagtcaatgtgatgcaaatgatgcaggcaatcagtgcggtggcaaatgatggcaagatgcttaagccgcagattgtatccaaggtggttaacaagaacggtaaagccactgtttataagccggaagtggtgggtcagccgatc

SEQ ID NO: 46 - DNA, 2726 bp, Lactobacillus rhamnosus; identical to SEQ ID NO: 33

SEQ ID NO: 47 - DNA, 448 bp, Lactobacillus rhamnosus
ggtatgggaagtcagacgggggggtcaactttaacgcagcaagtggtcaaaatgatgtttttaaattcggagacaacctttaaacgtaaggctgctgaaattatgctggcccggcgcttgaacaatcacttcagtaaaaacaccattctggcaacttatctcaatgttgctacgcttggtcgtaataacaaaggccaaaatattgccggagttgaagcagcggctcaaggactgtttggggtttcggctaaggaagttaacctgccggaagcggctttcatcgctggcctgccgcaaagtccatttgtctataccccttacacggccgatggtaaattgaaaaccagtctcaaagccggtatcaatcgccaacaaaccgtcctgttccgcatgtatcgggctggcgttatcagccatcgtcaatatgttgctgccaaatcatttgatc

SEQ ID NO: 48 - DNA, 479 bp, Lactobacillus rhamnosus
ctgccgatgctcaacaaacgattgatgctaacaaagaaaagctggcagccatggccgctgatgaagctgcaaagctgaggcggctcaaaaagcagttacagctgttgctagttccaccgctagtgcatcaagcacttctgcttcctctagcacaaccgcttcttcaaatagtctcggctctagtaaagctgcatcttctcaggctcccgcttcagctggaagcagcacagtttccgtgtccggtggcagcatcgccggtaacgccgctaaatacctcggcgtaccgtatgtttatggtggcacatcacctgctgggtttgactgctcaggcttaatctattacgcagctaaagaagccggaattagcctgccacgtacctctcaggcgcaaagcacacttggctcatatgtttcggtttccgatctgagttttctaatgcgcagattttcagaagttattcggcgttaatcccttgatc

SEQ ID NO: 49 - DNA, 2473 bp, Lactobacillus rhamnosus
gatcattttcttcatcttgccgattggactggcttatcttagcaatttgctatttaccaaaacactgcactatcaggtatcggaagactatgccttgcattacgactaatgggaggtcgaaaagcattcacgcaatatacgtgatttttgaagctttagtcggtggcaaacaaagagtagcttcttcatgccaccgaaactacatagagacgggttgttggcttcgcagttaatatgcaaagcaacactaaatatttttcttattggtattggcgtataaccgtttacatgataaaatgaggaagattttagtccctttgaaagcgaggcgagtgtcgtgttggcatggtgggcacagcaagaactgtggttacaggtgatcgtcggggtggtggcgctattgatcattggcggtctcttatggatgttgtatcgctggtgctgttacccgtatttagcgtattgcaacggctactgtcgccggttgagaacaccacatcaatgagcgatcgggattacttactcggtacgctgacgttagatgtggcgcatcattacactggcgaagtcatggtaaccggtggtggtcgggcccgccagacatatccggccaagctgtggtcggataaaagccagccgctaaatcagggcacaaaagtcgtgatcattgaactcaaacaaggtattgcctatgttgatgccttggctactcacaaccctaaggagggatctgatggaaattttaactgattatatgccgtggattatcgcggccgttttattgatcttgctctttattttcctggccacccatcgtaagaccgctttgcctaacgaagtcttgattatttccggtgctctaatttccggcaagcacagttttcgcgatgtcaatggcaatcgtgtcaagttgattaccaacggcggatcttttattttaccgattttacagcgctgggacgttttaagtctgaatacgcggaccattgaagtcgcaacgcctgaagtctacacgcaacaaggggttccgattattgtcaacgggacggttattttaaaaatcggctccagtcaggaagaagtcgcaaccgctgcggaacaatttttaggcaaaaatgacgagcagattaattcggaagccaccgaaattctggaaggccatttacgggcaattttgggcacattaacggttgaggatacctatcagaatcgtgatgcctttgccgaaaaggtccaggatgtggcgagttccgatttagccaaaatgggtttacagattatttcgttcacgatcaaagatattgccgacaagaacggttatctggactcactgggtaagaagcaaattgcggaagttaaaaagaacgccgctgtagccgaagcagccgccaatcgcgatacccggattcaacaggcgcaagcagatcaggaagcaaagcagcaggaaatcgaacgtcagacccaaattgctgacgccgaacgggaacagcaggtcaagatggctgacttcaaaaagcaacaagaaattgcgcaggcgcaagctgatcaggccgcgattgttgaacagatgaaggccaagcaggttcaaaaagaaaaagatattgaactagcacaaaagaacgccgaattgcaggaacaggaattgaatgcaaccgtgcgtaaacaagcggatgcggacttgtataaagcccagcgtgccgccgaagcccaaaaagcaacccagatcgcggccgctgaagcatcagcaaaagaggttgaattggatgccgaagccaaagcaaatgcaaccaaggcgattggggaagcagaagccggcaagaccaaggcgatcgggcttgctcaagctgaagcgattgctaaacaagcggaagcagcacggcaacttgatgaatctggccgcttcaagatgacgattgaagcaatgccgaagattattgaggctgctatgagtccgtatgcaaatgttgactcgattaagctttatggcgatggcgacctgacgaatcaaaccagcggcagtttggtcaagcaactggacatgctgcaagaagttgccggcatcgatattcgcgggatgttaaatggcgcactgatgcatcaggctggcaatcaaccggttgtcgatgcgatcaagcaccacgagcaaccagcagccaaagcgcctgacaccaagcaaccagcaccggcgccaaagagtgatcaaccggccactaccgagcaagcggcatcaagtacaccatcgcgcatggccgagaagcaaaagtagtcatgagtgaaattcagaatgattgatcagttgtcatggcactgggtgttctttgtgaatgtgccgctgggaattctggtctttggcttaattcaaattggctatcgggaaccgcggcgggaacatgtgtcgcttacgattgattggctcggaatcgcttggttagctgtcactttggttgccttgcttttaggcattcaagcactt

SEQ ID NO: 50 - DNA, 1601 bp, Lactobacillus rhamnosus
acagtcaagacactttcaagtacaaccaatttaaagtgctggattatatgaccaaggaaggcctgacttttaaggcattgacggcaatcacggttgacggtcaggacattttaaaggcgctaaccagaaaaatggtcttcatgacttccaatgacgcagcttggcaacacacacacaactatccattcgggtttgaactggactttctaggcggggtcgatcccgatgcggtacgaaacctgttgacccaatatgccggcaaacgcgtgaccgttgcctacaccggaatcgtcaatgagaaaatggtcccagaccaaaaagtcggtaacacggctgaagtgagctttgatcctgacagtaagattaccgtcaatggcccggaaatccagactggcgggattcgattcttcaaacatgaagccggatcttccaagagtttggccaacgcgacttttatcttacagcgaatgaacgccaatgtgcgcgaatatgcagttcttgaaggcgttaatggtatgcccggaacctaccaaccgaccaagattacctggacaacgaatcaagacgcggcaacaaaactcaaaaccagtggagccgagacagccaacttaaccattcaagggttgttgccagggcgatataccttggttgaaaccgcggcaccagaaggctatgaaattctcgatccgacaaacagattttgaagcccattgccggtacttggggtacgaaaacgattcgcatcgccaacacgccggtgaatcaattattgccaatgacaggcggaatcggactcttcgccttcctgatgatcggggccatcttaatgggtggcggtcacctcatgaagaaaaagaccagcaagaaagtctaatggcctatgacaaaaaaagcgtcggggacaagccggcttttacgctggttcgtcatcctactttttactgcgggagccgcgtgtttctgctatccgttcgcggcaacggcgattaatgaattgttactgaccagtcgccgagcagcagcgcagcaagaagccaagcaaaatgccgccgcccaagatgagcaacgggcagcggagaaccgcgcacttgcccagactggtttgcgcccgggacaggatccgtttcaaagcaggcaaaagtttaaccaagcctatgtgaaacggcatctgatcgggcgagtggttatcccgaaattagcggttgatctgcccctttttgacaccaccaacaacacgctgttagatcaaggggcagtggtgttaccaggcaccagctatccacggggaggcaaaagtacgcatacggtcatttcagcacacggcggcttacccaccaaacgctttttcaccgacctgagcaagttgaaacgagggcagaagttctttctccaagtcaacggcaaaaagatggcgtatcaggtctttcggatcaaaaccgtgcggccggatgaaacccagagcctacgcattgaaccgggacgcgacttggccacgttaatgacctgtaccccgtatatgatcaactcccaccgcttgctagtgaccggcaaacgggtaccttataccgaagcgcttgagcacgccgctgaatctgctgatc

SEQ ID NO: 51 - DNA, 1681 bp, Lactobacillus rhamnosus
aaagacacatcccttgctgcctcgatcaccattgtcgaaatgtttcaagtcagccaacaaatcgcggcggaaaattaccaaccattactgatgtactcaatcgttgcgcttctgtatgccattgtctgcactttcttagcttggggtcagcggtatctcgaaaaattcacatcacgctacaatgccaatgcacaaaccacgcaattataatccgccattttgaaaggaagaaagctatgttaaagaaaaagttgtggttcctgttgccgcttgtggccttggtaaccttcacgctcaccgcttgcaccagcgcatcatctgacacgtcaaaaaacagcgacgtcaccgccgaactcatcaacaaaaatgagcttaccatcggccttgaaggtacttatgcgccattttcttatcgcaaagatggcaaacttgaaggcttcgaagtggaactggggaaagccttagccaagaaaatcggggttaaggcaaaattcgtgcccacccaatgggattcgctgattgcaggattaggcagccagaaatttgatctcgtactgaatgatattagtgaaacgcccgcacgcaaaaaggtctacaacttcaccactccgtacatgtactcgcgttatgccttaataacccgcagcgataacaccaccatcaaatcgcttgccgatattaaaggcaaaacatttgtcgaaggcaccggtacacccaatgccgctttagccaaaaaatacggcgctaagatcaccccgtctggcgactttaccgtatcgcttagccttgtgaaagaaaaacgcgcagacggaaccatcaacgcctcggctgcatggtatgcctttgccaagaataactcaaccgcgggcttaaagagtcaaaccctcaaagatagtgtcgttaaacccgatgaagtagctggcatggtcagcaaaaaatcgcctaaactacaagccgcactttcaaagggcattcaagaactacgcaaagacggcacgttgaaaaaactgtcgcaaaaatattttggcaccgatttaaccaccaagtaatcatgccattcagctagcaaacattgcccgtcaacctgcttcattgacgggcatacataaaagaacactattcattaaaggaggtcgggtttcaatgacccaattcaataccaaactcgttcatggaccacaactaaatgtcgaccaagccggtgccatcgtgccaccagtataccaaagtgccatgttccgctttgctcctgatggtcaggaaacccactgggactatgcgcgcagtggtaacccgacccgtgaatacctggaacgtcagattgctacgctagaaaatggcgatgctggctttgcgttttccagcggtgttgcagcgattgcaacggtgctcgcgattttccccgaccacagtcacttcattattggtgattcgctctacagtggcaccgatcgcctcatcaaccagtatttttctcaacacggcctgacctttacaccggtggatacgcgtgatctggcagcggtggaagccgccatccgccccgaaactaaagcaattttctttgagactttttccaatccgctcctcaaagtcagcagcgtcaaggccatcagtgccctcgccaaaacccatgatctgttaacagactgtcgacgaacacgttgcttaacccgaaggg

SEQ ID NO: 52 - DNA, 754 bp, Lactobacillus rhamnosus
tatggtctaataagtccactttttttaaaaatatgtgttatttagccctaatccttcaatccggagtcaggtagcgttgatgttatgaccaaggcagatagggggttaagggatgcggttacaggaaaaggtcgccaaaagaatccacgaattaagactcagcaaatccatgacccaggaacaactagccgaaaaagccaacatggacgtttccatgctagccagaatcgaacgcggaagccgcggcgacatcagaatgagcacactagaacgcatcgtttccggattagacgtcagttatcaagaattcttcacttttccagaagacggagatgaaacaaccgaactggcttcttcaatcgctttgattaaagatccggaagttatccgggcactccacaagatcgtgaacacgttgattcatagggacaataagtgataaccatgcgtaaacgactgatcatgaatttatttaatccaacatcttttcttatatttttgatttcaaaatggcaattttaaattcttcctcttgtttttaacgtattcaatcaagtctcatcaaaaaagccgccagttttgtgcaaatgcacgcgactggaggtttttatgtgcgataactaaaagagtgaaagttgaatgtccggagaaagtcccgagaagacgggacttttggtgttaggcacaatgccgtctggtgttaggttaggcacaactttattcaggatgcaaaatatggtagactaaaattacc

SEQ ID NO: 53 - DNA, 1535 bp, Lactobacillus rhamnosus
gatcttattggcgctattgtttggcgttggtgccgcaacaaccagtgtgatggccaacacccaatacatgacagtcaaagccgagagcgtcaatgttcggctaggtcccggcttggcatatggcatcatgggtcaggtgaaatccggcaatgaattgaccattatcggttccaaaaattcctggtatcaagtgcgccttgccggcaataaaatcggttgggttgcttcatggttagtcgatcaaagcgaagccgcgaccacgagtgcgaaagttgccacggtgaatcaaccggttaacgttcgcgaatatgccagccaggatgccaagcagttaggaacgctcaatgccggtgatagtgtcaaggttgtgtatcaagaaggcgattggacccagattgcctataataatacggcggcatggatcactagcagcagtgtccagctcactggtcagacaactaatctggcgcaacctgcccaagccaatcttacgcaagccaaaagcggagccgcattgaaagttaccaccaataccataactaacttgcgcaatgcggcgggtatcaatgctccatccgtcgaaaagctcgataaaggcactgaattgaccgtcaccaaacaacaagacgattggtatcaagtcactgcccctgatggcaaatcgggttatgttgccagctggaccgtcaccgccccgaataatggtcaaacccaaaaagcggcaacgaaactatccgaagccacgattgttctggatcccggacatggtggtacagacacgggtgcgccggctaacaataatcatgattacgaaaaaacttataccctgaaaacggccgaactcgttgccaatgctttgcgggctgccggtgctaacgttatcatgacgcggacaactgacacctttgtcgaccttgcgccacgtccgacaaccgctaacaatgcccatgccgacgcgtttatctccttccattttgactccagcccgtccaaaaactcagcctccgggttcaccacttactactacagcagcaaaaaggatctcgccttggctaaggcggttaacaacgcttttgatgacttaccactagaaaatcgtggggttgcatttggtaactatgaagttctgcgcgataataaacagccggcgattctgaatgaaatgggttatatcaataacgacaaagactttaagtatattaaaaacccaacatatcaatctaaaattgcggacggatattgttaacggtttaaatgcttactttaaagccggtcatcatcaataatcggcggaaagtttgccgcggcaaaagcgcaaatcgaatataaagagccgctcaatcaggcatgaaaaattgctgattgagcggctctttatttgaattttttacttgcggaacaacggcggaatttcaattaaatgatcgacttgataatctgcctgtggtgctgcattgaggccgtccacattaaagtagatcgttttaacatcagcgttgataccggcatccacatcaagcgagcgatccactagt

SEQ ID NO: 54 - DNA, 2174 bp, Lactobacillus rhamnosus
accagttgcgtaaagatctcaagcacaagatgaagactgtgccgatcaagtattatgacacgcatagtaatggcgatattatgtcacgggcgattaacgatatggataacatcgcctcgacactgcaacaaagtctgacgcagatggtgaccagtgcggttatgttcgtgggaaccatttggatgatgcttacgatttcctggaagttaacgctgattgcgctggtaacgattccgctgggcttaattgttgtcgggattgtcgcgccaaaatcgcaacggttctttgccgcccagcaaaaagctttaggtctcttgaataatcaagttgaagaaacttatggcggtcaggtgatcatcaagagctttaatcgtgaagatgatgaagttgaggcatttgaaggccagaaccaggcattttatgatgcagcgtggaaagcgcagtttgtttccgggatcatcatgccgcttatgattttcctaaacaacattggttacgtgtttgttgcgattatgggtggcattgaagtttccaatggcacgatcacccttgggaatgttcaggcgttcctccagtatatgcagcaattttcccagccgatttcccagcttgctaacctagccaatacgattcaatccactattgccagtgccgagcggatctttgcggtgttggacgaagaagatatgcaggatgagccgtctggtgtgccggcagtggccaatgatcctaacaaactggtcatggatcatgttcagtttggttataccccggatgccttgttgctcaaggactataacctgcaagtcaaaccgggtgagatggtcgcgattgtcgggccgaccggtgcagggaaaacaacgatcatcaacctgctagagcgtttttatgatattagcggcggatcgattcgcttgaatggtaccgatacccgcgatatgaagcgagaagatgttcgcgcgcattttgcgatggtgcttcaggatacttggctgtttaccggcacgatttgggataacttgaaatatggccgcgaagacgcaactgacgacgaagtattggccgcagccaaagcagcccatgttgacaactttgtgcggcagttgccggatggctacaacacgattctgaacgaagaagcctcgaatatttcgcaaggtcagcgacagttgttgacgatcgctcgggccttcgtggcagatccggaaattcttattctggacgaggccaccagctcggttgatacgcggacggaaattcatattcaacacgccatgaaccgtttgctgaccgatcgtacgagcttcgtagtcgcccaccggctgtcaacgattcgtgatgccgacaagattatcgtgatgaatcacggctccattgttgaaaccgggaatcatgacgaactaatggctaaaaacggcttttatgctgatctgtacaacagtcagttcagtggcaatgtcgcgatttaattcagtttgcaatgatgctgagacctagacaaatattgcgttgcagggaaaatgtttttatcctgtgacatgaaaaagggtcctgaagacaagaacgatcttgccttcgggacccttttagcgttaccgtcgcttatggcgcataaacgttgcgtagtgtagcaaacaagcaagtaagacgaaaaagaggacaacaaagctgacatagcgccaccagaagttggttgccacgcctggtaggagttgctggatgcccatggttgccaaagccattaccgcgatcatgccgaacaacaataagtaacgtttcaaagtctcatcatccttctttttaaaagtggccaattttaccccgagcgcttgagcctgtttgaccttggccgctggtaaagccgtcatgccccaagtatgcgggagaaccagttccgtaattttatgtaaaccggcggcggtcatggctttgtcgatggtgacaagggtcgcatcggtctggtgcgtaaaagtgttgtccaggccggtggcaaaacaactggtgacgctaacgtaatgtttatctttaaactttcccgggagtgtatcgccgtgatgcgtcatccgagtgatgcgatggcgtaaacaatcgagtaactgcttaaactgtccagccacggttccaaagtaggtgggtgttccaagaatccacacatcagccgcttgcaacttttc

SEQ ID NO: 55 - DNA, 1337 bp, Lactobacillus rhamnosus
aagcttaatggtgctgcaggttctgtactgaacatcaatggcgggaatttgaccctgactgatgatggcgtatctgccggtactctgactggaggtggcttcctgaatatcagcggcggcgtcctcgatattacaggaggcaaccacacttttgctgtcagcaccataatagcaaaagatgcaactgtccgaatgaacgatgtttccggactgggtactggtaacatcagtaacgctgggacattatctcttactcatgcctcaggcttgctaagtaataatctgagtggttctggtacagtatctttgatcaatagtgatacccagatttcaggaaataacagtaactactcagggctgtttgtagtagataccagctctcagttgactgccactggagcgcagaatcttgggattgcttccgtgagtaaccgtggaatcttgcagctgaacaacacaacagactggcaacttataaataatgttactggaaccggtaatgtccgtaaaaccggttccggttcactgactgtccgaagcaatgctgcctggagcggacagacagatattgatgacggctctctgattcttgggcaatctgatgcacctgtcatgctcgccagtagcctggtcaatattgcaaagaacggtaaacttaccggatttggtggcgtagtagggaacgtaaccaatagtggaagccttgacctgcgatcggcggctccgggaaatattctgacgattggaggtaactacaccggtaataatggcacgctgctcattaacacagtgctggatgatagctcttctgcaaccgacaaactggtaattaaaggcgatgcgtccggtaagacccgagtggctgttacgaatgttggtggttcaggcgctaatacgctgaatagtattgaagttattcatgttgatggtaatgcagctaacgctgaatttattcaggccggacgtatagcggccggcgcttatgactacactcttggacgtgggccgggaagcaactatggaaactggtatctgagcagtagtaaaaatactccagaaccaaggcctgatcctgaacccactccggaagggcatgataacaacctgcgcccggaagccagctcctataccgcgaatatagctgcggcaaacaccatgtttgtgacccgccttcatgaacgtctggggcagacgcaatacgtcgatgcaattaccggagaaccgaaagcaaccagtatgtggatgcgccatgaaggaggacataaccgctggcgcgacggttctggtcaactgaaaactcaaagtaatcgttatgtgattcaactgggtggtgatat

SEQ ID NO: 56 - DNA, 1370 bp, Lactobacillus rhamnosus
ttataattacgggtgtaacttttcaaaacggaggtcatcatgctcgaaaaaaagttttatcataccatgttcagtcactctttcaatattccggtccgtgttgagtattgggaccacacggaagaaacatatggaacaggcgagccgacgatcacgattaaaatgaaaaaagcgatcccagtgcgtttgctgctaaagaatgcttcgcttgcattaggtgaggcctacatgcgtggtgacattgaggtgcttggtggtaagcggccgttgcagcaattaattgcggcggcctatgccaacgcggacagttttatgcgtaacaacaaactcatgcgcgtgttgcctaagcaaagccacaccgagcgcaagtccaagcaggatattcattcacactatgacttgggtaatgacttttacaagctatggctggatccaacgctgacgtattcctgtgcttattttgagaactgggatgacgatctggaaaccgcacaattaaataaaatcgatcacattttacgcaaactgaatccgcagccgggtcggacgttattggatatcggctgtgggtgggggacgcttatgttacgggcggccaagacctaccatttgcatgtggttggtatcaccttaagtaaggaacagtttaagctggtttctgaccggattgaagcggaacacctgaatgacgtggcggaaattctatatatggattaccgcgaattagatcgcgaaccgtttgactacattacctctgtcggtatgtttgaacatgtcggtaaggaaaatctagaagagtactttaaagatgttgccaagttgcttaaagatgacggtgtggccttgattcatgggattacacggcaacaaggcggggccgtgaatgcctggattaataagtacattttcccggatggttatgtgccggggatgacggaaaatctggcccatattgtcgatgccggtatgcaattggacgacttggaaccattacgccgccattatcagcggacgcttgaaatttgggatacgaatttcaataatcaccgtaatccgattcagcaaaagttcggttatgaatttacgcgcatgtgggatgtttacctgcaagccgccgctgcgagttttgaggccggtaacattgatgtcatgcagtatctgattagtaagggtccgtctggtaaggacttgccggccacccgtgactatatgtacgaatagtgccggaaatttagttaacggtttatggacacgacagctttgaaaaggtaccttcaggggtgcttttcttttatggaggagtattcaacttgacgaatatattagtgatcggggcgaccggcaatattggactgccgctgattcaagct

SEQ ID NO: 57 - DNA, 344 bp, Lactobacillus rhamnosus
caagtacagttacttccgtgctaacgaagactatgcagaaattgcccgctatcttgggctgccaggaaagaccaccgatgaattagtggaaagctatgttcaagccttcattaaattggcacatagcgtcgggatcaagttaagtctgaaggatcagggagttcagaaagcagatctggacaagcaagttgatcgccttgctgaacttgcttatgaagataactgcacggttaccaacccgcaggaaccattgatcagcgatttgaagcacattattctcgatgaatatgaaggaacggattcaacattctaagtacgcacatgctaatcatttcacgatgatc

SEQ ID NO: 58 - DNA, 1511 bp, Lactobacillus rhamnosus
gatcggttcaacgcgcaatggggtttgcgaatcgtcttcaaatgatgtcatccactcagcccagtttgccttgttagcaactgcagcgcgataccaagcagtttccggtacggcatcagctttttcggtcaatgccttgatgaatttcttggcatcggctaagaccgccagatcggatgtatgttgaaaaatatattgcgtccgccaaacacgttgaggtacaagttctgggcgatgaacatgggcatctattgcacctttttgaacgtgattgttcggttcagcgccggcagcaaaaagttgttgaaattgcccctgctgtggctctgccgttagcattaagaaaccgtatctgtcaaagcgccgttgatttaatggccagtctgcattatgaaaatgccggcactgtcgaatttttggtcgatggcgatcagtattactttattgaagttaatccacgtgtgcaggtggaacataccatcacggaattgattaccggggtcgatattgttcagtcccaattgcgcattgctgccggggccgatttatttgcggacctgcacttaccacagcaagatgcgttacgggaaaatggggcggctattcagtgccgcattacgactgaagatccagaaaataacttcatgcctgacaccggcacgattaatacttatcggtcaccaggcggctttggcatccggcttgatgttggtaatgcctatgcgggtgccgttgtcagtccatattttgattcgttactggttaaggcaagtgtccacgcacctagttttcctgctgcagtggctaagatgcagcgcgcgttacatgagtttcaaattaccggcgtcaagaccaacgtcgcctttttggaacatttactggcaactcagacattccggaccggtgaggcagaaacggcctttattgatgcgcatccggaattattacaagtgcaagcgaaaccagatattgcatcccggttgctttggtatatcagcgatgtaaccgtcaacggctttaaaggcgttgaacgtcaaagccaaaagtactatccggagttgcaatatacacgccattttgctgctgctaaaccgcagacggatttggtggccctacttaaaaatgaaggtgcccaggcggttacggattgggtcaaggctcatccagcgctgcttttaaccgatacgactttccgcgatgcccatcaaagtctgtttgcaacgcgaatgcggacccgcgatatgttaacggtcgccgaggatatgggaaacggcttgcctaatctcttctcaatggaagtttggggcggcgcaacttttgatgtggcttaccgctttttgaatgaagatccgtgggtgcgcttaaagaagttgcgggctgctttaccgcacaccttgttacaaatgctttttcggggtagcaacgcggtcggatatcaaaattatcccgacaatgttattaaggccttcattaaccaggcagcaaatgacggtgtggatgtctttcggatc

SEQ ID NO: 59 - DNA, 1721 bp, Lactobacillus rhamnosus
ggtgccaatgccgttgtgcttgaaggcgtaaccgtgggcgaaggggctgtcattgctgcgggagccgtcgtcattaatgatgttcctgctcatacagtcgtcgccggggtcccagccaaggtgattaaaaaagtcaacgatcaaaccgaagctaagacagtgctgcttgatgaactcagaaagttgtgacatttaatgaaggaagccgaactcattgctattcgccgccagctccaccaaatcccggaattagcgctgcaggaaaaagaaacccacgccttcctgctcaaaaccatccaaagttttccgcagacttttctcaccatccgcaccttaccgaagttgccaaccgccattctagtcaaagtcactggctccgatccgcaacgcacgatcggttatcgcgccgatatggatgcgttaccggtcaccgaagcaaccggtttgccgttcgcctcgcatcatccggggattgcgcatgcatgtggtcacgatatgcatatgaccgtggcacttggcgttctcagttatttttccattcatcagccaaaggatcatctgattttcttcttccagccggccgaagaaagcaagaatggcggcaaactcgcttgtgacatgggcgctttcaccggtgagtggcagattgatgaattttatggtctgcatgatcggcctgacctgcctgctggtacgattagcacgcggctcggaacgctttttgccggaaccactgagattaacgttgatttaatcggtaaaagcggtcatgcagcgctaccgcaaaatgctaacgatatgatcgtcgcagcggccagtttcatcagccaaatccaaacggttgtcgctcgcaatgtcggccccaccgatagcgccgtgatcacattcggcctcatgcgcgcaggaaccatccgcaacgtgattgccggtagcgcccatctagaaggcaccttgcgcggcttcacgcaaaagcaaattaatttcttgcaacagcgaattcgggatatcggtcaaggcatcgcggccagtttcaactgcgaagtcaaagtcgatttgaatcaaggcggttattatcccgtcgaaaataatccgcacctgacaaaagatttcattgatttcatgcaagccgacccagccgtgacctttgtgccaaccgatccagtcatgaccggtgaggactttggttatctattaaacaaaattcctggcaccatgttttggctaggcgtgaatgatccggattcgcagttgcacgccgctgacttttcaccagatgaagcagctctagcgccaggtgtgacggctatcattcattttctgacgcatcggatggcggaagcggcttgagggtcttgattgatagtgtgcaagggcagtcacggattttttgatgatggcttgccagttggatttaacataatgcgttcgccagcccagaagtctacgtgtaaggaccttaagcgcaatggccaggaccgggccatcacgcttaagccgcttacactccgacttctaaccgcgccggctcgcgctcagggggtttttaaatgcaaagagcagaattaatcaccgcgattgtgacaccgtttaacgaccgcgatgaaattgactatgatagtatgcaacggttagtcgatcatctcattgatcaaggcactgacgggtttgtggttggagctacgacgggtgaagggcctacgttgagtcatgatgaaaagatc

SEQ ID NO: 60 - DNA, 802 bp, Lactobacillus rhamnosus
ggcaacaactgtcgcatcggccgagaatacagatgtcatcacccaagctgttacgattactgacgccagtgggttaaaactcgggcctgaaaccgtacagctttcaagcaatgactttgttgacagttttgatcagaagaaattctacgttgtcaaagacgcaagcggtaagttaagtacaggtgatgctggcgactatacggcggatgccaaagggaaaattgcgattgtcaaacgtggcagtctgactttcactgacaagcagaaatatgccgaggccgctggtgcagcaggcttaatcattgttaataatgatggcacatccacacctttgacttcgatttctctaacggctacttttcctacttttggtctttccaatacgactggccaaaaactggttgattgggtaactgcgcatccaaatgacagtctgggcgtaaaaattgccttggcattgttgccaaatcaaaattataaagcagatcggatgtcaagtttcacttcatatggccctgtatctgatctttcctttaagcctgatattacagcgccgggtggtaatatttggtcaacgcaaaacaacaatggttatacgaatatgtcggggacctcaatggcatctccatttatcgccggctcccaggcacttctaaaacaagcgctaaataataaagacaatgagttctatgccgattacaagcaacttaaaggcacagcattaaccgattttctcaaaacagttgaaatgaatactgcaaagccgattaatgatattaactatgataatgtcatcgtctct

SEQ ID NO: 61 - DNA, 805 bp, Lactobacillus rhamnosus
accatgttgacaaaaatgatccggcaactggttcatttgccaaatttgccagtgagtacatgcatccgctttttggctatttaaccgcgtggagtaatatcttccaatttgttgtggtaggcatgtcagagatgattgccattggtgaatacttcaaattttggtggcccgagctgccggcatggctgcctggcctggttgcgatcaccttccttgttttggcaaatctgatttcggtgcgaatgtttggcgaattggaattctggtttgctttgatcaaagtcgtaaccattgtgttgatgatcatcgctggtctcggcgtcattttatttggactaggaaatggcggtcggccagtggggattagtaacttgtggacccacggcggatttttcacaggtggctttacgggcttttgctttgccctgtccattgtgcttggttcttaccaaggcgttgagttactcggcatcacagctggggaagcggaaaacccgcaaccaacaattgttaaagcggtcaaagacaccatcggacgaattctcatcttttacgttggtgcgattttcgtgattgtagccgtttatccttggaatcaacttagcgccttagggtcaccctttgttcaaacctttgccaaaatcggcattacctttgcggcatcactcatcaactttgtggtgatcaccgccgcattatcaggttcaaattccggcatttattctgctagtcgtatgctttacacattggcagatgccaaacagttaccgcgaatcttcacaaaactaaatcgccatggggttcc

SEQ ID NO: 62 - DNA, 890 bp, Lactobacillus rhamnosus
gatcataatcgggacaaccattgttattccggggattgtgatgcacttcttctgcggtggtatcgcggcaatctttggcaatgctacgggtggtcgcaaaggtgcgctgattggaccgtttatcggtgggattattctaagctttttgcctttggtcgccaccggtctttatggaggcttgggttacactgcaacttattggtctgatagtgatttcaatacaatcggggtcttacttggacttgttgctaaagttggtaagtggccgatcatgctggctgcattgattatctttgccttcccatttgtctttagtgctttacacaagaaaaaactggttgattaatagcaacttttgaattaatagcgctgatatataaaaagtcgatctcatgaagagtggccgcatggcaaacgcgactgcttttcaggatcgactttttatgtactgcatagcgatctgagttttctaatgcgcagattttcagaagttattcggcgttaatcccttgatcagagtccaccatgacgcccttcgtttcatcaaacacgcaaatgttgccatagttttccttaaatcccatgtgattgcccccatcaatgaaataacgcggcgattcatgggggtactgaatgactttaaccggacatttcggatagtttccagttaagggagtttcgggaactggcggtttcgcatcgccggcatagtcaccgtagattaaggcagttggtgtatgtccggtaacaatggttttgttaagcggattgtgcgcaaagatgggatgctgacgcgtttgggtttgctgcatgtcataaatataaggctcccggacccacatgcggttaaacggtgtggtctcttttaaagggttctctaaggatagatc

SEQ ID NO: 63 - DNA, 2278 bp, Lactobacillus rhamnosus
acttggtttcggttgaagaaatcaaagattaatacattatttcgacaaggaggtgcccaagagtatgcaattgcacgaattaaagccgagtgtcggctcccgtcatgcccgcaagcgtctgggccgtggtacttctagcggtcaaggtaagacagctggtaaagggacaaaaggtcaattggcacgacaaggcggcaagacacgtcttggcttcgaaggtggccagatgccattattccgccggatgccaaagcgcggtttcaacaacattaaccgcaaagaatatgcaatcgttaacctttccgatcttaatcgcttcgataacggtgctgaagttacaccagctgccttgatcgatgccgggattgttaagaacgaaaagaacggtgttaagttgctggcagacggtaaacttgagaaaaaattgaccattaaggttgcaaaagcttcaaccgcagcaaaagctgccgttgaagcagctggcggttcgattgaggtgatctaatgctgaggaccctaaaaaacgcgctcaaggtcaaagacatccgtaacaagatcctcttcactttagcggttttattggtctatcgattaggtacactgattgcagttcccggtgttaatgccaaggcgctgcagtcaatcggctcgacaggcttgatctcactgctggatactgtcagtggtggcggattggcacaatactccatcttttcgatgggggtttcgccgtatattacggcccaaattgtggttcagctgctgcagatggatatcgttccgaaatttgtcgagtggagcaagcaaggggaagtcggtcggcgtaagctgaatcaagttactcgttatctgactatcgcttttgggttctttcaggcaattgggattacggccggctttcaaacgttaagttcgatgggcttggttaaaaatccgtccgttagtacctatatcacaatcggtatcatccttacaggcggcacaatgttgctgacgtggatgggtgaacagatcactgataaaggccttggtaatggggtttcgctgttgatcttctccgggattgtggcacgcctgccttcaggtctccaggagttatatcgggataacgttcaggtatactctggttctgaaatctggaaaggaattgcgtttttagcagctttggcagtcatcgtgatcctggttatcacatttgtcacctgggtgcagcaagctaattacaaaattccaattcagtacactcggcgcgttaccagcgcgggcagtaacagttacctaccgcttaaagttaacgttgccggtgttatcccggttatttttgcgagttcctttattgtgacgccgcaaacaattttaatggcttttcagaagaatcatgggactgacggatggtatcaagtcatgaccaatgtcttcaatatgcaaaagccagccggaactgcgatctatacgcttttgattattctgttcacgttcttctatgcgttcgttcaggttaatcccgagaaggtcgcagaaaacttaaccaaacaaggcagctatattcccggtgtttggccgggtaaggaaaccgagaattatatctcacggctactcatgcgcttatcaacagtgggtgctttgttccttggtttggttgccttactgccacaactggctgccaacatttgggggttgccgcaatcaatcggacttggtggtacgagcctgttgattgttgtcatgaccgctattgaattggttcgccaattggacggcttactcatgaagcgtgagtacgtcggatttattcgcggtgatttggttaagaacgataagaagtaaacgatatcagaagtcagccattttcaatggttgacgcgttaaaagcagcgtacaaactggcaagtttcagcgttaaatcgtttagaagctgttcacagcagttttaaatacatgccagcgcgtacaattagaggaggatgcaacgtgaatctcattttaatgggacttcccggtgcagggaaaggcacgcaggcagaacggattgaggatacttatccgatagcacatatttccaccggagatatgttccgagccgcgatggctgctggcacagcattaggtaaggaagcaaagggctttattgataaaggtcaactggtacccgactcggttaccaatggcattgtcaaggaacgccttgctgagtccgataccgatgcgggctacatgcttgacggctttccgcgcaccatccaacaagcagaggcactcgaaacgatcacagctgatc

SEQ ID NO: 64 - DNA, 522 bp, Lactobacillus rhamnosus
gatgccgcggggaattttagggtcactcttgattgccgttttcttattcgtttcggtgggactggttttgttgggaatgtttccatatcaggattacgccaacaatgcagaaccggtcggctgggcgttgcgccactcaggtcacgcggtggtcgcaaccgttgtcgaaagcatcgcggttttaggtatgttcacggcgctcattggtatggcgatggcgggatctcggctactttacagttttggacgcgacgggatgttaccgcatggtttaggaaaattgaacagccgcaagttaccgaatcgggctttggcggtgctcatcactattggcgttattatcggtgcgttctttccatttgcgtttcttgcccagctgatttccgcggggactctgatcgcattcatgtttgtcacacttggcatttaccggctgcgtccgcgtgaggggcaggacattgccaagccacgttttcggatgccattttacccagtgttgccagcggttgcctttctcggatc

SEQ ID NO: 65 - DNA, 670 bp, Lactobacillus rhamnosus
tggcaacatattgcgcaatcaccgcaagctaaaaaggctggtctgaagctcaaagtcaaacaggtggcagacggcaatgtaacaaattcggcaaccgctgaagggcagttagatgtcaatgcgtttcaatcttacgcgtatttcgaacagtataacaaggcaaatccaagtcaaaagttggcggcacttggcactacctatttagagccgatgggattgtattccaaaaaatataagcgattaagtcagcttcctgatggtgcaacgattggcatttccaatgatccggcgaatgcaacgcgcggtttgttgctgctggctgcggccaagttgattacgttaaagccggattttaatgccttgagtaccgtcaaggatattcaaagcaatccgaaacatttaaagttcaaagaggtggatccttcagttcaggtattgcccgacctagatgcaggcttgatatcaaatacgcgtgctttggatggtgggctaaatgttttaaaggattcgttggtgcatgagaagctgagtcaggatactcgtgccaatgtgaatattttggtgacggcggttaaaaataaaaacaagctcgaacttaaaaagttagtcacgctttatcacaactcaacgattcaggcctggatcaagaagactttttctggtactaaaa

SEQ ID NO: 66 - DNA, 341 bp, Lactobacillus rhamnosus
gtttattaactgaagagattgcgggcattttcattttaggaacaaatggcgagtcttacgtcttagcggaagatgaaaagttggcatttgtagaacatgttatcgactatgtccatggtcgaaccaaagtactggtaggaacaggtttgaacggaacagcggaaaccattcgcttcagtcaaaaggtagcgtctttaaaaccagacgcaattaccttagttgctccttcatttgttgctccctcgcaacaggaacttgttgatcacggctgggaagaaagcaaccagtacgttgggtgtgacggcagtcaataagacgactttgaaagtaaccctggatcc

SEQ ID NO: 67 - DNA, 732 bp, Lactobacillus rhamnosus
gatcgcggctatctgagccagtacatggttaccgacaacgacaagatggaagctgatctggatgatccatatatcctgattaccgacaagaagatctccaatattcaagatattctgccactcttgcaagaaatcgtgcaacaaggtaaggcactgttgatcattgctgacgatgttgccggtgaagcactgccgaccttggttctgaacaagattcgtggcaccttcaatgttgttgccgttaaagcacctggctttggcgatcggcgcaaggctcaacttgaagatattgcgaccttgacaggtggtactgttatcagctccgatcttggcttggatctgaaggataccaagattgaacaattaggccgtgcaggtaaagttacggttaccaaggacgacaccaccattgttgatggcgctggttccaaggatgctattgctgaacgggttaacatcatcaagaagcagattgctgatacgaccagcgacttcgaccgtgaaaaactgcaagagcgtctggctaagttagctggcggggttgctgttgtcaaggttggtgccgcaacggaaaccgagctgaaagagcgtaagtatcggatcgaagacgctttgaacgcgacccgtgctgcggttgaagaaggctatgttgctggtggcggtactgccttggtagacgtattgcctgctgttgctgctttgaaagaagacggcgatgttcagactgggatc

SEQ ID NO: 68 - DNA, 1589 bp, Lactobacillus rhamnosus
gacactactggatccaagtaaggcatcggaaggcgtttccggccaggcgattattgataccatgaatggcctgtacaagtattatggtcataaactacagccggcaatggcaaccaagattgtgaagccaactaacaatgggcttacgtatacttttacgttacgcgatgctaagtggagtgacggcaccccggtcacggcacaggatttcgttttcgcctggcagcggacggtcaacccggccactaagtcatcccaggccaatatgtattccggtatcaagaatgctgacgacatccgcgctggcaaaaaaccggccgcgacccttggcgtcaaagcaatcaacagcaagacgctggaagtcacgttggaacatccgattccctatttcaacagcctgctaaacaatgtcgccttcttcccgcaacccgctaaaaaagtgcaggaatggggcaacaaatacggcaccaagtccgaatacaccctttcaaacggtgcctttaaatccaaaggttggaccggtaccggcgacaagtggaccgaggtcaaaaacaaccgttattggaatcaaaagaatgttcacctgactcaaatcgatgttcaagtggtcaaagacaccaatacggcactcgacctttaccacaccggcaaactggatgatgccacgttaaccgggccaacttgccgcacaacaaaagtaagaccggttatgtcgccaccaaacgcgcccgcacgtattttcttggaactaaacgaaaacaaagtgcccgcgtttaagaacacgaagattcgccaggcaatttcaatggccattaatcgcgattcttttgttaaaaatgttcttgctgacggctcaatcgttgcacgcggcatcaccccggccgacttgagccaattgcctgacagctcaaccgattttgccactgcggttggtaagggcacaaaaacaatcaccacatataacaagaaaaaggcccaaacgctctggaatcaagggcttaaggaactcggcattaagaatgttaatgttgagcttctcggtgatgacgttgatgcagtcaaggcgacccaagagtatcttcaaggaacgcttcaggaaaatctgcctggcttgaagatcagcattgccagcgtaccggccaagaatcgccaacagcgggcatcgacgcgtgattttgacatggtgctaagtacttggggcgcagattaccctgatccgaatacgtatctggatctgttcaccagcaccagtgagtacaaccacggtcaatggcaaaatagcgattacgaccagctcatggccaaggccaatggtgctgatgccaacaatccaacggcgcgatttaaggacatgacgcaggccgaacaactacttgttaatcaagccggtgcgattccgctttatcaactcgttgccgcgcggatggttaatccaaaaatgcacgatctaaaaaccagcccgggtaacagtttcaactttgtctatgcttatttgaagtaaacgaaagccgtttccgctcatcatctgcggaaacggctttttatagtgcgctaacttcaataaacattatctgcatcaaccacaggcg

SEQ ID NO: 69 - DNA, 425 bp, Lactobacillus rhamnosus
gcaagctgtgtttatctggtatttttcctataaaatcaagctataaaaagaaggaacgattgtgaaaaacatttcggattatcgtaataaaaaggtgcttgtattgggactggcaaaaagcggcgtcaatgcagcgcgcttactacataaattaggggctttggtaaccgtcaacgataagaagcagttcgatgacaacaaagaggctcaggagttgttggcagacgggatgcgcgtgattaccgggcgccatccagttgaattgttagatgagcattttgagttgatggtcaaaaatccgggtattccatacagcaatccgatggttcagcgcgcgcaagaattgggcctgccgattattactgagccggagctagcttttcaggtatccgaagcagagtggatcggcattaccgggacgaatg

SEQ ID NO: 70 - DNA, 803 bp, Lactobacillus rhamnosus
cgatcgtgtttttagcttatttgggttacagcatctggaacatttggcgttacatccataatcaacggcttaagtggccgcattttgggctgtcgttggataccagccgcctgcccttccatctgccccaagcggtgacggtttttggcattgccttttttgctttgatgacggcagtgagtgaaatgaatcgaccacagttgctgacgcggacctttgatcgtaattacatcgtcaaatatctcgggttggcgccttttacaatttacgatgcagctaaaacggcacaaaacaatcaggtacgggctcaggcagacagtgcaaatctcgatccggttctacaatacacgcgttcgcattatgccgctcctaacgctagctattacggagccgctaaaggcaagaacgtgatcatcattcaccttgaaagcttccagcaatttctgatcggtcaaaaaatcgatggtcaggaagtaacgccatttctgaactcgttgattaaagaaaaagacacgttaagtttcaataatttcttccatcaagtcggactcggcaaaaccagtgacgcggaaaatatgctggaaaccagcacgttcgggattgccaacgggtccttgttcagcagtctgggaacggaaaatacgtttgaaggcgccccggcgattttaaatcaacgcgctggctataccagtgctgtcttccatggcggctccgcttcattctggaaccgcgataatgtttataagagtcttggctataacaattacttttccggcaacttctataatcatgatgaaaaagca

SEQ ID NO: 71 - DNA, 1115 bp, Lactobacillus rhamnosus
tgtggtcaaaggcgttaatttaaacgttgcaaacaatgaagttgttgtcatgatcggggcgtctggtgccgggaaaagttccgttttgcggatgatcaatggtcttgaaacggtgacaagcggcgagatcttgattgacggtgaagacattgcgcataaaggaacgaatatcaataaagttcgcgaaaaaatcggcatggtcttccagcattttaatctgtttccgaacatgtcggtcatgggtaatattacgttggctccgattgaactaggcattgccagcaaagaagaagcaacccaacaagctaaggagatgcttgaagtggttggcttgaccgataaggcagatgcgatgccggcacagctttccggtggccaacaacagcgggtggcaattgcccgggcattggctatgcatccggatattatgctattcgatgagccgaccagtgccttggatccggaaatggttggcgatgtcttgggcgttatgcgccgactcgctaaacaagggatgacgatggtgatcgttacccacgaaatgggctttgctaaagaagttgctgatcgggtggtcttctttgacaacggtacgatccttgagcaagggacgccgacagacattttcgagcatcccaaagaggagcgtactaagagcttcttaaataaggttttgaatgcctgaggttattcaaatttaatcataagatatgctaaaaaatcggttcgggatattatcctgagccgattttttgagtggtattttcgaaattgctgtcacatttcccgggaaataatccggatgcttagcagaacatggacgtctcacgccaaaccgtggtctaagatacgatccatgacggcggcgacactgccagcatagcccatgccgaacttatcaaggtgaaccatcagataatacagccggtagaattgagcctgaactgatagccgggatcaagtggataaacttcctgatagcccgtgtagaagtcttgggtgaagccgccgaaaacggtcgtcacgccgatatcgagttcgcggtcgccatacaaagcggctggatcaattaacgccggctgacccgtctgctgtgaacatatagttgccacccc

SEQ ID NO: 72 - DNA, 425 bp, Lactobacillus rhamnosus
gatcaccttgtccaatcaactgacgccatcacgcaacgcccagaaatattttgccaagtatacgaaattacgcaatgcagtggcgcatgttcaccagcaaatgcaggaaaaccaagaagaactcgactaccttgaaggcatcatggcgcagattgatgtagctagtccgaaagatttagtcgatattcgattggaattacagcaacaaggctatctacgtaaacagaaatccggaaaaaaaggcaataaacgccaaaaagtctccaaaccagatcaattctatgctagtgacggcactaaaatctgggtcggaaaaaacaacttacataatgatcagttgaccctacacaccgcgaaaaaaaccgacatttggctgcacgtcaaagatatcccgggatcacacgtgattatcgatagcagtgatc

SEQ ID NO: 73 - DNA, 2271 bp, Lactobacillus rhamnosus
tggctcgtatcaaatggcgacagttttcaaggacaatttgaatagttgacaggccgcgcggcgaggactgctccatttggtgtaaaccgccagcttgatttgctttttatcttggtaaggcttgggatcgcgttctttaaacgggtaacgtgccacatcgaccgggaaattgataatgtcaatcggactgttagttttgcaatgtgtcgtaatcatatgtgcgcaccaaggccctagtgaaaccatgtgcagtccgaggctataagtacggcgcgccatctggtaacgatcaccgtatgggtagaaataaggttcataatcctggacaaaatacatcttataacccggcttatttttgatgacataaacggattcccataaaagtagcgacccagatgtcagaacggtgcgattcgagttctcccattggcaaacaagttcctttatagcctggatagttaaattcggcgttttgaatcatctcatcttgactttgcggaacgtaacttagatagtaaacgtcataacccgcattggctaacaaggttcctaaatgcagcatggttgtttgaccaccatcaaagccgatgataccggtcgttacaaaagtgatccgattgccgcgcggtttggtttgatcggcaggccgatcgttgaagtatttaagtatctgatcatattgatgaatactaccatcaggagcgtcactaaatttagtttttgcaggtttcacagccattcctcctcaaaatttttcgaacgatgaagtgcaggcaaagactcgaaaattaggcagaaaaaagaagtctggtgtcacgggctgcttgtcagcggcgatacccgattaaactaaaagacgatgcaaatgcctgacgcttattttagtttacataataaccgtaagctaaatagtgatcgttttcaagtttgccaaggttggaacggcgtattctgaatgatagagagggttttgccataatattatgaaggtttgttttgaaatattgccatcggactggaattctttttgtaactggccagtatgatcgtgaagttcgaggacctgcttggccagtgaaatttcagcttttcttcgcgcctgttcaaatcataatgaatgcttatctttaccgtgagatggggctgtgctagtgtgaaagtatcgatatcaatgaaagaacaggtgaacctatgttaacgattggagtcattggtttaggcacgattgctcaaaaagcatacttgccagtttacgcgcaaatgcaaaatcaagtgcactggttattgaatacacgcaatgaagacaagttagaacagctttcagcacagtacgggcttgaaagtgcaggccattcgctacaagacctcgatggacaaccacttgatgcggtgatgattcatacaccaaccgcgacccattatcagtatgttaagcattttttggaaaaaggtgttcatgtttttgtggataagcctttagcaaccgatatggcgcaagttaatgaattatatgatttggccgatgcgaaacatgtcatgctgacggttggctttaatcgccggtttgccccaatgattcaagatttagcgcaagtgacagataaaacaggcgtccgcgttgataagaatcgcattgatgcgcttgatgacaccgaacatgcgctgtgggatcttttcattcatccggtagacactgcactgatgctcgctggctatccggaaaaaccaaacacccgctatgccttgcacaccacaagtgatggccaacttcaacaagcaagtgtcactttcacagctcccggtattcgtggggaagctggaatagatctgcaggcaggaaccaacctagaagaggcgcaagtggcagctccaagcggtgtgcaacgcgtccaaaacttagaccaactggttgtgtatggccgtggcggtgcttcacaaacttttgccccagattggcagcctatgcttgaaacccggggatttgcgccaatggtacaggcatttgtccaggccgtgggtaatccagatggccagaatccggtatcaccggcaaccagtcaattagcgcacgctgttgtcgccgatttggtcaatcaaattaacaactagacagggtactaacccaaaatgcttttgaagatcgataaaatgaaatctgccagcttgaacatgagtgtcggaccagcagataaggaaggggacaagtgctatgtatcaaaaatcatttatggcaatggctgatgaagaagcaaaagcaaatgttaacggatc

SEQ ID NO: 74 - DNA, 1030 bp, Lactobacillus rhamnosus
ctgaggtttatgcagacggcttttttgtgcacactttttgtacaaacaccatcactaagcgactgcaaaatagttgcggtacaatagcaccaaagcggtgaaaggaatgaagggttcatgcacattgcagtcattgatgatcaagcagcgactagagaagcaacggtcaagctcattcggcagttagcgcaaccgtcacagccattgcaggtggcggcttattcaaatgccgagcagttcctgtttgcagaaaaatcagccgatctgctgttgcttgatattaagttgggatctggcatggacggcatggcgcttgccaaaaaaattcgccaacatgatcccgaaaccgccatcgcttttgtcagtaactacgacgaattcgtgttcgatggttacgatgtgaacgcgattgactacatcctcaagccgcttacggtggcaaaactcaaacacctaattgaaaaggtagctagccagacgcagccaaaactcttggcattgcaaaccgctgccggtctagtacgcgtgccaatgtatgacatcagcgccatcgaagtcacggatcaccggcttcaagtccatacgcaaaaaaatcactatctggtaaacggacagttaaaagactttttaccgcgcttagatgacaactttattcagatttaccgctccatcgtcattaacctgaatttcctctcgcagctggataaacgaaccgttgtgatggcagatggcaccacttatcccgtttcccgccagcaggcaccgctagttaaacaggcattcttcaagcattttcgggggttgacccatgacagcaattagttggttctggctggtcgcctttgggttgctagtagtaggttgtatgtggcagttatggtggatttttcggcgccagcaaaactggccggtgcgctggttaaacctcatcattgccatcgtatcgttgagcagttggtggttatggccgcttccggttgtccgcggcttgctttttaccatcactgtgttagcaggcagtttggagttc

SEQ ID NO: 75 - DNA, 791 bp, Lactobacillus rhamnosus
ctgatctgaatgagagtattgttgattttattcgggacttttctcagcctgaagctgctttgacgggtgctgatggtttgtatttggcagaagaggggatttttgatgccattgtgctggatattatgctgccggagctgaatgggtttgatttgcttaaacagttgcgagctaagcaagtgaaaaccccggttcttattttgacggctaaagatgctttgacagataaggtgcgtggttttgagttgggtggtgacgattaccttaccaagccattccaccgtgaagagctcattatgcggttaaaagcattgttaaagcggacaggacatttttttgatgaggatgggttaacagccggtccgtttgaagtccacctaaaccggcacgaagtcttaattcacgacaaaccagtagcgttgaatggaaaagaattcgacttgttagtgtacttattacagaatcaaaaaaccattattacgaaggatcagatttttgatcggttgtggggatttgattcggatacggccgtcagtgtcgtcgaagtttatatgtcgaacttgcgcaaaaagttaaaaccgatgcaagccgacgtatggatcaaaacaattcgcaatgtcggttacatctttcaggaaccggaggaccgtgcatgaatgcagataaaggcattaagcgacaacagcgacgtttatttatcggtcaactactgagcttcgccggactttttctagtgctgggggtcattgtttttttcctttatgaacgttcgatttatcaagatatcgatc

SEQ ID NO: 76 - DNA, 623 bp, Lactobacillus rhamnosus
aaactgcaccagcaacagcgtataccaagatggacgattttctcggcagtgatgtcgatgtggtgtatattgccagtcctaacagtttgcatgcgtctcaagccttggcagctcttgatgccggcaagcatgtgattgttgaaaagcccttggttgcaaccgctatggaatttgaaaaactagacgaggcattacgcaaaaagccttctttgtatctttttgaagcagctcggcatgtttatgagcacaattttcaggttgtcgatcaatttacccatcatcatccgattgacggggctaccttgacttatatgaagtattcttctaagtacgatgcttttttggctggtaagttgccgaatgtttttaatcccgagtttgccggtggtgcattgatggatctgggtatttatttggtctacgatgcggtggcttggtttggggttcccgataacgctgtttacctcccgcattttctcaagagtggtgtggatggcgatggggttgcgcgcttggattatgatcaattcgccgtgacactgattacgggaaaaacaaccaatagtttcctgccatccgaaatttattccggtaagcaaacgttgactatggacaatgctgct

SEQ ID NO: 77 - DNA, 1420 bp, Lactobacillus rhamnosus
gtagtcaaaaatctcctctggaatatggggtaccaagttttcattcttttacttccgattgttactattccttatgtttctcgagttcttggaccgacaggaattggcatcaatgcatttacgaattcgattgttcagtattttgttctatttgggacattggggctaacaatgtatggaaatcgcgaagtagcctatcagcgcgacaatcctaaacgtttatcaggtttgttttgggaattaaccttgttaaggcttgttacgacaggcattgcgacgctgctatatttgggcttcatattgctgtcaggagaatatcaagtcttctatcttattcaaggacttttgctggtagcgacagcgattgatgtatcttggctttttcagggtcttgaagaatttcgtattaccgtgttaagaaatactttggttaagatcatttcgctgatactgatctttgtccttgtccgaacaaagaacgatctttggctctacatcctaattcttactggttctcaagttctggggaacctaacattagtaccatatttaaaaaaatacgttgttgtgccgcattggtatgatttgaaagtcattgatcatttacgtccgacaatcgaaatgtttgttccgcagattgcgacacaagtatatctacaagtcaacaagacaatgctgggagcccttgttggggttcaggcatcaggcttctatgataactcagacaagatcgtcaaaatattacttgcagttgtgacagctacggggacagtgttgcttccgcacacggcgcatagttttgcacaaggaaaacatgatgaggttgaagcatcattgaataaatctatgcacttcattcttgttatcgcatttccaatgacaactgggttagccggaatcgcaccaatattcacgaaaatcttttttggaaagggcttcgacccggttgctaatttattagtgatcgaatcgatagttattgtacttattggcatcagtaatgctactggggttcaatacttactaccaactaatcagcttagaccgtttacgacatctgttgtttttggggctgttgccaacatggtattgaatgtgcccttcatcttaatttggggcagcaatggagcgatgattgcaacggttctatcggagttattggtttctatttaccagttaagtaaggtgagaaaccaacttcggatcaggtcgctttttagtgaagtatggaagtatttggttgccgcgcttttaatgggagttagcgtacgagtttttatcaatgtattaccgttgtcaaactttctcgctttgttaggcgcaacaatgtatggagctttgatatatacgcttgcgttagtcatacttcgtccaaaaattttattgcaaatgatttcatctttaagaggccttaggtaat

SEQ ID NO: 78 - DNA, 679 bp, Lactobacillus rhamnosus
gatcggatgacggcttttatccaaacgatgagtcatctttccgcgcttcaaaaccgtcagctaaccggtgaggcgatgacgccggccaccttggaacaacaacttaaagaagaagctagcaaacttgttccggctaccaaaacggttacttggaaggtcgagaaccagatgacaacaaacgagtcgcttgcaattgcaccggatgtggtacttgaagttttcgataatcaactgaccaatgcttgtcggtttgccgctgagcaggtggcgattcacttaaccgcaacggcaaacgggttgacgataaaagttgataatgatggtccgccgttgactccgggtgaacaagctaaagccaagttgccgtatttttccagtgaccgtcaagcccaacatctcggggtcggtatgtacatctgtacgcaattatgcgcggcgcatcggggtcattttacaattgccaatcaaccagatacccaaggcgtcagcaccattgccgaatttggttttttaacgcctgcctccagctcgactgattgatcaagtttgaaatttttgcttgggtaattaatggcgaatattttggatgtaagctgattcctgagacagcttcttagcggtcatttgaacgctaagtacagaagtggcttttagtttatatcaagtaacagttagctca

SEQ ID NO: 79 - DNA, 487 bp, Lactobacillus rhamnosus
tctaaccgcgctggctcgcgctcactacaaaaggggagagtagatgtcgttaccgatatttttagaactggttgaaattcgcaccaaactggcaagtgttttgccatttgcgattggtactttgtttgcagtgacttattttcacgcctttgattggctcaatacgcttttattttttactgcaatgttgattttcgatatgatgacaactgcgcttaataatttgatggattatcaaaaagccaaagatgctcattatcagcaggaagtgaatgtcattggtcgggctcagcttgatccgggaatggttgccaagttgattctggtaatgcttgtggttgcttcgttgctgggcgttgtgttggtcgtgcggacggattggctgttgctgttaatggggatggcttgttttgccattggtattttgtatacttgggggccattaccgctttctcgtttgccgcttggtgaaattttttccgggatc

SEQ ID NO: 80 - DNA, 1136 bp, Lactobacillus rhamnosus
ggcactgaggtacaaaacacggcggtacagcgcatcattgaaacttttcaggcagaactcactgggccaaatgcgctgaagtgattggaaccgccaccatgcaggcgtaaactaaaggtgtggttaatggctcatctgaaaggaagcatttattttgaaaattgccaaattaaacaaccatccctatctgataacgtctgcatcaacagcgcaacccattaccaatgctgccgatgttttgacagctttaacccaccgcgacaccttaacattcggttctgaaattaactttaaaccggaacaattagaggcgccggtagctgctagttcccagatttttgctatcggaatgaattttcttgatcattcgcaagagattcacatcaagttacccgaagttccgagcgtcttcactaaattcagtagctcgctgaccggtccgacaagtacggtacctatccatgggcccaaaaccgattgggaaaccgaattagtcgtgttaatcggtaaaggtggccgcaatattgccgaggctgatgcacttaagcatgtcgccggatttttggttggcgaagacttcagcgatcgtgccgtacagtttgccaatgccgaaccgcaattttcgctagccaagtctttccaaaactactcacccattggtccctgggtgacgtcaacagatgccatcacaaacctcgaccaattacaaatcacgaccaccgtaaatgggcatatcatgcaacaagccaaacttgatcaattgatttttaaagtgcctgctttaattcactatctcgccgggattgtggcgctacaacccggagatcttatctttaccggtacaccgagtggaacaggcgtgggccgtgacccgcaaatctttttgcaaccgggtgatcacgtgacggctgccatttcacagttaggggcattgaacctgacaatgccaacaccgcaaaactaagacaaccgattccaaccatcaaaacctataccattttaaaaacaactaggaaaacgccaccatatagcgtatcctgaagatgtctaaaaaatctaagaggtgaatttgatgttggaaaacaataactttgatgaagttgtcatgaagcgtcatactgcccgtgaatttgatc

SEQ ID NO: 81 - DNA, 746 bp, Lactobacillus rhamnosus
aattcaaacgagcagcctttaaaaaagtttccgactggcaaaaatatttgaaataggtgattgaattgaaacgtattatcgtagggattaccggggcatccggaactatttacgctgttaacctgctccagcatttacatcgcctgcctgatgtcgaagttcatttggtgatgagtgcttgggcaaagcaaaacctatcacttgagaccgacatgaaacaaagcgaactcgaagctttggcggattatgtttatcctgttcaaaaccaaggggcaaccattgcaagcggcagttttttaaccgatgcaatggtcattgtcccagcaagtatgaaaaccattgcgggcattgcgatgggctttgatgataatctcattggacgagcagccgatgtcacgattaaagaacagcggcaattgattattgtgccgcgggaaacaccgcttagtccaattcatctggataacctcgctaaactagcccacattggcgttcaaatcattccgcctattccggctttctatcagcatccccaaaccatccaggatttaattgagcatcacaccatgaaactattagacgccttgcatattaaaaccgaaaccgctagtcgctggaatggagcgtcgttaagatgaaaaaagttctcaataaacagagtatcggttttctcatcggcattgcggtgggcctcattgtttacctggccccactgagcggcatcaatgaaaaagcgcaaatggatc

SEQ ID NO: 82 - DNA, 1442 bp, Lactobacillus rhamnosus
aaagatatgagtatggtcattctggcgccacaaatggaaagtatgaaggataatttgaaaaagattaccgataaatatggcgttaagttggttacaaccactggtcgccagtacattgaactgacaaacaacggtgatatggcactggattttgttgagtccaatctttaggtgttcaacaacttagacagactcgtctgcatactttataggaggaagttaaaacatgcgtaaacaattacccaaggactttgtaatcggtggcgcaactgctgcttaccaagttgaaggggcaaccaaagaagacggaaaaggtcgagttctttgggatgattttctggaaaaacaagggcggtttagtcctgaccccgccgctgatttttatcatcgctatgatgaggatttggcgttagcagaagcatatggtcatcaagtaatacggctttcaattgcctggtcgcgaattttttcggatggtgccggggcggtggaatctcgtggcgttgctttctatcatcggctctttgctgcctgtgccaagcatcatcttatcccgtttgtaacgttgcatcattttgatacaccagaacggttacacgagattggtgactggctgagtcaagaaatgctggaagattttgtcgagtacgcgcggttttgcttcgaagaatttccggaaatcaaacactggattacgatcaatgaaccaacgtccatggcagtgcaacaatatacgagcggtacttttccaccagcggaaaccggtcattttgataaaacatttcaagccgaacataatcaaatcgttgcccatgcgcgtattgttaatttgtacaagtcaatggggctagacggtgaaatcggtatcgtgcatgccttgcagacaccttatccatatagtgattcgtcggaagatcagcatgccgctgatttacaggatgcgttggaaaatcggctgtatttagatggcacactggcaggagattatgcccctaagaccttggctttgatcaaagaaattctggcagccaatcaacaaccgatgtttaagtacactgatgaagagatggcggctattaagaaggcggcgcaccagcttgattttgttggcgttaataattacttcagcaaatggctgcgcgcttatcacggcaagtcggaaacgattcataatggtgatggctcaaagggatcgtcagttgcccgccttcacggtatcggcgaggagaagaagccagccgggattgagacaacggattgggactggtccatctatccgcgtggtatgtatgacatgttgatgcggattcaccaagattatccgttagtaccagccatctatgtcaccgaaaacggtattggattgaaagaatccttaccagcagaagtgacgccaaatacggtcatcgcggatcccaaacgcattgattatttgaaaaaat

SEQ ID NO: 83 - DNA, 793 bp, Lactobacillus rhamnosus
tttattttgcggccggtaacgacctgccttaagcctaaatgccattttgattggtagctatcagacaccaactcgtaaatgacctaaaaattgacacatttaatctttctataaagggagtttcgcatgaagaatcgactcgatgatattacagatttaatggcacttggtccgactccggatgcccgtgacattcagcgacgtcaaaccgcccaccgaatcgcaattgcagacgcttggcaaattcaaccaggcgaaaacatcttggaaatcggctgcggtcaaggtgacttaagtgcggttttggcagatcaagtgggtcccagcgggcatgtcaccgggatcgacattgcttcgcgcgattacggtgcaccgctcacactcggacaagcatgggatcatctgttaaacggaccgttagcaagtcggctgacagtacactttgataccaatctcgccgccagcctcggaccggttgccaatcaacattttgaccgcattgtgatggcgcatagtttatggtactttgcatcggccaatgcgtttgccttgcttttgaaaaacctgcgcaccattggcgattatgtcgatcttgccgaatggtcccttcaccccaccgcgctcaatcaaattggtcatttacaagccgcgatgattcaagggttactttatgcgattgcgccaagtgatgttgccaacattcgcactttaatcacgcctgataccttagcgcagattgcccatgataacacatggtcctacactgctggcaagctaatagaatgtccggatc

SEQ ID NO: 84 - DNA, 156 bp, Lactobacillus rhamnosus
aacttatacaggcgcaacgattggtcacctttctgccgcccagaaaaaggccgcttaccgatttggccggcagctcggcatggcctttcaaatgattgatgatttacttgattatacccaaactgccaaaacattgaataaaccggcgcttgagga

SEQ ID NO: 85 - DNA, 847 bp, Lactobacillus rhamnosus
acgctaaccgactggcaaacagcaattaatcatactttagacgaacaattggcaactgtggtcaatccccatttgcgtgcggcgatggcttattcggttgatgcaggcggcaagcggttgcggccgttgctgttattgagcgttgttgctatgtacgatggtgtggttgccgaggcattaccggctgcagctgcacttgaatttgtacatacctattctttgattcatgacgatttgcctgctatggataatgatgatctccgccgcggtcagccgacgaatcacaaacagtttggcgaggcgctcgcgattttggctggggatgcattgttaaccgacgcattcgctatcttaagccagcactatccgggaaaaggtgccgaactcgttcaaattctggcagaagcggctggcagttcaggaatggttgcaggccaggtacttgatatggatggcgagcaaacgcaatatgacctagcaactctcaaacagatgcatcaggctaaaaccggcgcgctgatccaggccggtgtggcaatgggtagtttgtttgtcgcgattcccgaagccgatcaagctgccttagccgattttgcggctgcttttggtctgggttttcaaatcaaagatgatatcaatgatgtgactaaaaccaccgcggaattaggtaagactgccgataaggatgtggccgaacacaaaaatacatttcccgaactgctgggattagccggtgccaaacaagcattggcgacccagtttcagctagccactgctgcgttaaacagcctgaccgttgatgcaaccgacttaaaatcgattttggcggtgttacaagcatgacaaa

SEQ ID NO: 86 - DNA, 342 bp, Lactobacillus rhamnosus
tcgaacagattcagcagcggctggaacaggtcgttactttacgcgaaccacaagtgcatacgttgattcagcagcaaatcaatgcaggcggcaagatgttacgaagcgggcttatgcttatgctagcgcgttttggcgaacctgtcaacgctgagcttgtgacggctggtgctgcgattgaagcactacacctagccacactggttcacgatgatgtgctggatcatgccgatattcgtcgcggcatgaccacggtttctgccgagtccggaaatcgtgaagccatctatgccggtgatttcctgtatgcaatctattttcaattgcttagcgaacaggatc

SEQ ID NO: 87 - DNA, 300 bp, Lactobacillus rhamnosus
cgcgaaatctggcctataaagcggcattggcgctccaacgccatgccaatatccgccaaggtgcgcggattcatattgaaaaacacattcccgtcgctgcaggtttgggcggtggttcgagtgatgcagctgccgttttgcggggcttaaattcactattgcagttaggttatagtcgctcgcagctggctcgcatcggcttacaggttgatagcgatgtgccttactgcgtttactcggagacggccttggttaccggacgcggcgatgtggtcacgccattgggaagtttaccgaact

SEQ ID NO: 88 - DNA, 121 bp, Lactobacillus rhamnosus
gccagagaagtggtatctggtggcgcaccctggtgtaagtattccgactccggtgatttttaaagatcctgaactcccgcgcaatacgccaaaaaggtcaatagaaacgttgctaaaatgt

SEQ ID NO: 89 - DNA, 941 bp, Lactobacillus rhamnosus
ggaccttgaaggaaacttatccggctatttttgtggtcgatctcgaccagaatgaaaatgcgttcgagcgtgtctcttatagttacgcggatcttctgactaagtcaatcaagatcaccttcgaaggcgaagaaaaagcgtcataatttcagatactaaccgacgattaaatcgtttattttgagcaggcctcgatgtcattggcatcgaggccttttgctatcttcttgaaagactgatctgtacaaggtgacgaatttttgacacgcggcaatgaaaatccggacgcaaaacagtatactgaaaataacgatacggcggatgcatgcatcgtcgtttgcagtgtgagctctccctgtaaatacatgcatcgccagagactggtggttagatggaactgatcgagaaagcgccggccaagattaatctaagtttggatgctttgtatcgtcatgctgacggcgaacatgagtggcagatggtgatgacatcagttgatttggctgattacgtgagcattaagcctagccatagcattcaggtttccacagatagcggttttttacctgaagatccgcgaaatctggcctataaagcggcattggcttaacttctatcatggaaggttttgatctctcattactggaggcgatttcgcatggtgttgtcggcgtgacctatgacgttaactacggtccaaacgaaatcgtgcaagacggcatcaatgggtatgtgactccgtatggcgatattcatgccttagcggagaagattcagttattgctatccgatcgtgacaagatgcagcagatgagtacgaatgcatacgaatctgctaacagatattctgaagaaaatgtttggaagaaatggcccaaagttttaatggatgcacaaaagagtgaggggaaggtgaccaaatgatttacatgggtggtgaa

SEQ ID NO: 90 - DNA, 326 bp, Lactobacillus rhamnosus
gatcggtttgacgacagcacgccctgttttgtacgaccggattaatgcgcgcgtggatactatgatggcagcaggcttagaaaatgaagtcgccaacctgctaaaaacggttcccccggatgcgcaggcgctgcaggcaattggctacaaagaattgatcccgtactttcgcgggcaagctgatttagcaacctgtgtggccttgattaaacagcattcacgtcattttgccaagcgccaactgacctattttcgcaaccagatgccaacacattggtttgacttggttgcccatccagaagaaaagactgctgtccgttgctttg

SEQ ID NO: 91 - DNA, 363 bp, Lactobacillus rhamnosus
gatcaagcggacttggcggcccttggcgtcagcagtcctgaactcgatcgactgattaatgttgcccttgataacggcgcatatggggcgaaactgaccggttccggcatgggcggctgcatgattgcccttgccgccgcggaccaggcaccggcaattatccaggcactaaaggtagccaatgccgttaaagtctgggaataccactttgaaacgaaatgaggctgctatgacaacttatgcacgcgcgcacactaacattgcattgatcaaatattggggcaaagcaaataagcaattgatgctgccggcaaccagcagtatttcgcttactctaaatgacttttacacggacacggcggt

SEQ ID NO: 92 - DNA, 493 bp, Lactobacillus rhamnosus
cgcagatggcctattcagttgctaagtttaaagccgcagctgaggcagccatcacggacgtcagcagtcggcgccacctgccgattttagttggcggcaccggcttttaccttaacagtttgcgcctgaatttaccgctgggtggcaaggcaccgccgactgcagtccgtcagcgttggcaggcagcattggcagaaaatggcgaacactggttgtgggagcagttgcagcagcaagatccagtggcagctaaccaaattgaatcggcaaatacgcgccgggtgattcgggccttagaagtcatcgaattgacaggtacgcgcttttccgagcagccgcagccgcaaccacgctatgagacgttggtgatcggtttgacgacagcacgccctgttttgtacgaccggattaatgcgcgcgtggatactatgatggcagcaggcttagaaaatgaagtcgccaacctgctaaaaacggttcccccggatgcgca

SEQ ID NO: 93 - DNA, 322 bp, Lactobacillus rhamnosus
atacgttatgggttccggttttaggtaatgtcaatgccacttggttttatgtgatattcgttgttttttggctcgttggttttagtaatgcggttaatctgacagatggtttggatggcttggttgccggtcagacaaccatttcatttgcaacgtatgcagtgattgcggttcgtgaaggccgcgttgacgtgttgattatttgtctggtgactgtcggcgcgatgcttggatttttgatgttcaatcataaaccggcccagattttcatgggcgatttgggatccttggcattaggcgggatgctggcagttgctgccat

SEQ ID NO: 94 - DNA, 716 bp, Lactobacillus rhamnosus
ctgatcatcatctcggctatttgggtcagcatttggcagcaccaattaacgctgagtgtctggatttccttatttattttggttctttatggcttgttaggattttatgatgatttccagaaattggtgcaccatcgtaatgaaggcttaaaggcgtggcaaaaattagccggtcagattcttggcgctgtcatttttctgatccgcaaaatcgcagtttcggtatcaccaatcagctgtttttggatattgctaaaagcggctgcaaaggcttgctgcttggtttcacctttgccagataccgtgacgacttgatgtttggtttcattgacgactgtcatttataaccgcactccttacgcttcgggatacttcttgttccacgcttcgaccagtgctttacccaacgcttcttgatccataaagccaaaaccgagaactttagtgccttcctcgatggcagtcacaccttcttgaatcgagcgcatgccatgacgttccggccatccatattgcgtatgcgcggtaatcgcccccgcaccaccggaaccacagaagctaatgcccatatcggctttttctttatccatcacctgacccaaacgcatatccgcccccataccaggcaccacaacggcagtaccaccagcggcttcaacccctttagcaacgttttgacccttacccatccgatctgcgataactactttaaccat

SEQ ID NO: 95 - DNA, 465 bp, Lactobacillus rhamnosus
cggcacggattcccgcgcatattgcgattatcatggatggtaacggtcggtgggcaaagcggcgattgttgccgcgggttgccggacacaaacaaggcatgcaaaatgttaaaacgattaccaaggcagcaagtcgtctcggggttaaagttttgactttgtatgctttttcaactgaaaattggaagcgccccggttctgaggtgaattacctcatgcgcttaccggttgacttttttaacgattttatgcctgatttaatcaaagaaaatgttaaagttgaagttatgggtgagttaaccgacttacctgagccgacacgcaaggcgagtgaaaaagctatggcggatacggccaacaacaccggcatgattcttaactttgcgctgaattatggtggtcgtgacgaactggttcacgctgcccggaaactggcaagcgcggtgcgtgatggtcaattagatc

SEQ ID NO: 96 - DNA, 402 bp, Lactobacillus rhamnosus
gcttatagtgagctggtgtttgtcgatgattattggccggatttctcgcctgctgcattggaggcggcgatcgcaacttaccaggctagagaccggcgttttggcggtttaaaaaaataatcaactaaataaatggtgatggaggatttgttatcatgaaacaacgggtcataacggctgtcgttgctttggcaatttttattccaattctaattgccggtggcggttggatcgatacagccggagcagtcttagcgctaattgcgttatcagaagtgtatatcatgcggaagcgcatcattctttcgccagattttctgattgcatcgcttggtatcttggcggtggttttgccgaatagctttttccgttggctgcctgcctttttagggcggattgatc

SEQ ID NO: 97 - DNA, 921 bp, Lactobacillus rhamnosus
gggggattattatttagttttgaaatattggaggggtaaatttggaaacagcatctgaacatagacggaccgacgttgagcaagttaatcttgggggattgacaccgacctacctagtgtcaaagcgttgttttgacgttgcagccagttttatcggtctcgttctgctcagcggtgtttttttagttttagcagtactgattaaattagatgatccgcatggaaaggtattttattcacagactcgactaggtaaagatggacggcgttttcagatgtggaagtttcgttctatggttgctggtgcggataagatggttgacaagttacttaaaaagaatgacgttgatggtgcaatgtttaaaatcaagcaagatccgcgtgttactcgtatcggccgtgtcatacgtaaatatagtcttgatgaactaccccaactttttaacgttttacgaggtgatatgagtttagtgggtccaaggcctcctttgccccgcgaagttgtaaagtacactgagtatgatagacagcgtttggctgttgttcctggagtaacgggtttgtggcaggtttcaggtcgtaatgagcttggctttgacgaaatggttgctttagatattcactatataaatcatgctagtgtcgctgaagatttcaggatcttgttcaaaaccattcttgtggtaattcatccgacaggtgcgtactaattaattgttttaaaagttagctctattcagtttaattgtatgtttattcgtgagaaaagttgaatcgtaaaattttgacttacgaataataagcattgttaaagagtaaatctatcggtgagtgtggctctccaaaggggagtcttttttgttatactatggcgggaatctgacaataagcctcaataataccaatcctacaaagtactcg

SEQ ID NO: 98 - DNA, 258 bp, Lactobacillus rhamnosus
ccatgtcggcaacggcagaggcaaagtctggcccggttcttgctaaagcgcacgattcgcgaattacaccagttggcaagtacctacgcaagttccgattagacgaattgccgcaaatttttaacgttttaaaaggtgacatgtcaatcgtggggccacgtccagagcgtccttattttgtcaaccagttcaaccagcaggagccgcattactacctgcgtcacaatgtccgggcaggtattacggggtatgcacagg

SEQ ID NO: 99 - DNA, 1315 bp, Lactobacillus rhamnosus
  misc_feature (1)...(1315): n = A,T,C or G
ggatcaaatgacttctggaacttcggtgcatattgtgcgtcggtgcttgaaaccaagttaccatttgtaaagctcagttgggcgccggtcaattccttggtcggatcgtctttaaccgcaaattggttttcctgcttcacttttaacgtccaaccttcaaatgtgccgcgcttgtcggtcacctggataaagttcgggcggtcaacggttgtgccatcgtcttgtgtgaaagtttgcggttttgcgtaatacgttgcatcttcatgactaatttcagcttctccaaaaatgagacttgaagcaaagtcgatcgacaacgggcccccggtgccacccggaactttgccaccaggatgagtaggatcggtcggcttgcctgggttcttatcagcgggatctaatgggtttttcgggtcagtttggctttgatccaacttaaacttaacctggccatttgaagtcacatcactagcagaaaccagtgtcggtgttactccagccaaacccaacatacctaatccaagcattgatgccatcacgtaaaactttttcatgtttattcttcctctttcttgtttgtgttagattgttttgtcagcaaaatcagtagcatcagcaacaccagtagtagcccgattaaactcacaagcagtggggtcatcattcccaaggctggtagctggtcttctttggttggtggtggtacgttcacctgttgctttggcttgatctgttctggtgacggttgattaaccggctgctcaacttcaaaaaagctaatttcaccggatgtttgtgtctcgactgctagcgcttgcgatggtggacaagtaaaaccgattagcaaaactaccagcagtagccactttttcatcacttggaaccaccctcttaattggtcggcacatcttgaactgaccattcaaactcacctgtaaaagttcccaacttttgcttctcgactggcaacactaacttgagcccacgagcctgctcgtcagtggcctgattccactgactgcttaacgactgcggtgacgtcatgtctatctcttctgccaaaacagcttgatcagaaagctgttgttccgtgcctgagcggttgatgtagcttagacaactggtcacatcgagattgccatttttaaacggctttataactttgacatagactttgactgacttagctgccgccgttcgagtgtcttcaataangaattcaccatcaactttgggccttaggatccaaagaattcaaaaagcttntngagagtacttttagagcggccgcgggcccatcgattttccacccggg

SEQ ID NO: 100 - DNA, 1889 bp, Lactobacillus rhamnosus
  misc_feature (1)...(1889): n = A,T,C or G
gatcgcattttgaccatcgtgactgattgcagtcgatgccatttgaccagcgacaacgccatgagttgaataaaaatcttgatgattatagatgccggctgtataaacgccatcgtcacggttgcgcaacgtcttcaaagtggacaaagtgatcatgcgtaatgattatcacagcattttgagttgcctgccataagtcaaacaacagggcgtgcatatcggcacgagtgtgattgtccagtgcactaaatgattcatctagcatgagtaagggtggctggttaataaaggcgcgggcgagagcaactcgttgttttaggccgccggaaaggtcatagataggctgattggcgaaatggcgcagtccggcgcggtcaaggagagctggtagattgtcagctgattggtaacgcattttaggaccgaatagaatattgtcgcggacatttaaccacggataaagtgccattgattgaaagacgacaccgcgttcccatgacgggcctgcgatagggatgccgttcatggttaaggttccttgactaggtggcaggtagccggcaatcagatttagcaaggtcgttttaccaatgccggaaggaccgacaatgacggtggtcgaatttgatgcaatgtttaagttaatattgtggacagttggtaagcgctcattttggtaacaataagctacatgatcaagtgtcagtaatgacatgattgccccctagttgagatatcgcggtgtaatgaaacgatcgcagtctttttgactcactggtttggttaatgtttgttggcgccacataaattgtgccgtttcgaaaaattgcgcgcgaaattgtcgcgtcataaatgttcgttgggattgatcggatagccattgagaggtgccaatctgtttcttaacggtggcaaccggtagcgaaaggctcttggcggccgttcgatagatgctttgaggaagatcttgatactggctgtggatcttgtttaaagttgccaataacgttcgaagcacatctggctgtgttcttatgaaagcatctgttgctagggtcacattggcggttaggtgaccggtttgcgccatttgacgactatcaatcagctgtttgttgcccaataatgccgagaggctgggttcccaagtataagcaccatcaatatcaccacgctgccaagccgccacgatttctggtgtttgcatgtcaagcacctcaacctgattggttaagtggtgctgctggngtagcatcatcaagctataatgcgatgttgaggcaaacggggtcgcgattttcttatgcttgagttgtccccatgtgtcgattccggctttttggcgaattaccaaggcctcgttactgccgatgatgtcgttaatccacactagtttagcggaaataccggcagccagtgcaaccacggcattggtgtgccccatggttgccaactgaacatcattggcgatcaaggctttgttggcatctaccccagagtcgaaggcaatgaactgaacggttagcccttttgcttgacaggctttctgcagtaggtgacgctgacgggccacggccacatcgttaggaacccgaaggacgccgattttaatggtccccgctgatgtaggtgtggcgtgacaactgctgagcccaagcaaggagcagatgagaagcaacacccacagccataggcgatgatggtttgtcatgatgcccagtcaactccttccttgccatttgatgaaatgctgaccgaatcgcttgagtaaccagtctagtaacacgccggtaaggcccatgacaatgatatcgactatcatgacatcacttttaagataatgcgaagcgtcgatgaccatccacccaatgccactggttgaggcgatc

SEQ ID NO: 101 - DNA, 1020 bp, Lactobacillus rhamnosus
  misc_feature (1)...(1020): n = A,T,C or G
cacttacctggtaccccacccgggtggaaaatcgaggggcccgcggccgttctaaaagtactttcgaaaagctttttgaattntttggatcatcaataccgaagngaagcanagctactcaagtncacgcacacagcgtatttgaaagcaaagcanatgaaggttttggttgaanatctgtttgagtataccaaggttaaatcaaccacnaccaagctgaatccggtccggttcaatatgattgcgatgttggaacagcttgccgcgagctttgagttggaagcccataanaaacacatgcggattctggtcagcggcgaaccgaacccattaatgatggaagctgacactgaaaagctgggtcgcgttttcaataatctgatcgtcaatgcgttgaaatatgggcaaggcggacggcacattttccttgacgcccancggattggcagcgaagtcgtcgtgaaggtttcaaatgatggggctcagattcccaacgatgccttaagccagttgtttgatcgcttttaccgggtagaagaaagccgctcccaagaaaccgggggcacaggactagggttggccattgcgcaaagcatcattgcgttgcatggcgggtatatttacgcagattcaagtcctgaattaaccagttttgtgattcatttaccattaaaagttggcgcttcgctgacggataaacaaactaaatntaatgaggaagcaggaaagacgaaatgaagaagttgttacgtgggttggttgccgcaatggtcgcggtattaatgataggcggtgctgctccagcggtgtccgttgcagctgccgaaagcagtgatacaaatctggttaatgccaaagccgcggttgcaattgagcccacaactggcaaggttttgtatgctaagaatgcaagcacggttttgccgattgcatccatgnccaagatgatcagtattgagttagttctcgatnccattaaatcaggcnngatcaagtgggacgacaaggtgacgttggatc

SEQ ID NO: 102 - DNA, 1734 bp, Lactobacillus rhamnosus
  misc_feature (1)...(1734): n = A,T,C or G
gatcaacccgcagatgcaatttgacccgcaaaacattcggattcacgggattacacctgatatggttcaagaccagccgtcttttgatcgggtttggccgcatattcaaatgttttatacgcctggtcggattgtcaccgcccacaacgcaccgtttgacgtttccgtattgcgcttgacacttgatcgctatggcattgccgcgccacgctatcaggtcattgatacggttaaaacatcacggcagtttttaccaaagttaccgaatcatcgtttggatacagtcagtgctgcactcaagattccgcttgagcaccatcacaacgccttagcggacagttatgcctgcgcaagaatcctcattgccgaaaatgaacattttggtgaggcgcggactaaagccatgatgaaattagctaaagcaggctgcgattaacaaattagcgcataaaactaaaaaacgagtgcaattttcgctgcagcttaacacgaaaaattgcactcgtttttattttcaaattgtaaacagcacgctgctcgtcaaatgttgaaatgcatctttgccagccatttttatttacccgttcagtcaagcgttcacaatttctttttcagcttatctttttacgacatgccgctctgacttccagatgctaaaggatgtcttcatcgactgccacaagccggagcctgagtaaaccaacacattgttgcgatagactttgaccgtgaacattgtaaataaggccaagaaggcgatgctaattgcaatactgatccacgcttcgcccatacttgctcgtcccagtgacatttgcgtcggcatcacgaagacatttaaaaacggcacataactggctatttgagcaagcattgaatcacctgactgcgcggcaatggtaatgaagtagccaactaaacccagcatgctaatcggcatagcagcttgttgcacctgctcctgattggaaaccagcgaacccgtcaaggcagctaacaccgaaaatgttagtgttccaataacaaagaagatcgcgatcatgccagtagtcccggaaaatagaatcgagaaatcaaactgtttcaagacccctgcgaccatgctttggtttttaaggaattgccaaccaatcaatccggcaacaagataaattgccagctgcgtcaacaacaaggcgaagatcccggccagtttaccgaagaactgagtcgtggcactgacggatgatagaangatctccataatccgggagcctttttccgtcgcnatttcctgcgcgagaatggagccgtaaaccatcgtcaccatcanaatcagcaccatcgacacaacggcaacaccatggttcatgagttgcgtggagtctgatttgggtacttgcttgccatcttcaatcgcgactgtttttgaggtaaccacaggcggttgcgttaaggcggtaacttgtgcaggcgtcaagtgcatgctggcagcggtactgctgagcttaaggccgctcagtgcggtgacaagggtcgacgtgtcaaccgtttgcccgttatcgcgcgctacataatgggaacggaaatggtcagcggccttcaccgttaaaacgccgtcaatcttctcatcatttaaagcagcattggcttttttatctgacgaataaaccttaaactttaagtcatcggtactttgtttgcttaatgcctgacccacggcgctaacgtnactgacaacggccacttgggcag

SEQ ID NO: 103 - DNA, 1386 bp, Lactobacillus rhamnosus
  misc_feature (1)...(1386): n = A,T,C or G
attagaatcagtagtttaacacattatacacttaaaaattggatctccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtacacttacctggtaccccacccgggtggaaaatcgatgggcccgcggccgctctanaagtactctcganaagctttttgaattctttggatcttcttggctatgtctgtttttttactgccaataacagggtttatttttgaagggggttattcatattgcaagtacaaaagcatgactgtcgcacgagcaaccgattggataaaagactcaggcatcaaatcaaacgcggcaaaatgaccgtggcgttaaggaggtgccttggccatgtctgatccagccaagatcgccacccaaatcatggctgctgtaggtgggatcaagttgcgggattgccgctcttatcaatcgcaacggacacttttgttgcggttggacttccactggtcttaggcgcggcatttaccacgcagcgtgatcgtgttcaaccgtatttgcgccgaagttggccatggtttgcagttgccggtggcggtttgatcgtctttggactggtgggtcggatccttaccatgcctgcgatgacaattgccttagtacctgtgttggtgagtttgatactcggtgccggcttaatttggcaagcacatcaagtacatttaaacgtgacacaaaccaatcacggggtagttgtcatcggggttgtcccacagacaccagccgcacaaatggatttgcagccgggtgatcgggtcttgacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagacaaagtacgtagcgagccgtttgactttattattctcgatctcatgttgccgagtttgagtggactggatgtcacctgtaagattcgtgaagaaaagattcaaacgccaatcatgattctgacggccaaagacaacgaaaccgataagatcgtcg

SEQ ID NO: 104 - DNA, 939 bp, Lactobacillus rhamnosus
  misc_feature (1)...(939): n = A,T,C or G
aatcttacagttacatccagtccactcaaactcggcaacatagatcaaaaataataaatcaaacggctcgctacgtactttgtctaaagcctcctgaccatccgttgccgtttcaacctaatagtgttcagcctctaaattgtattgcagcaaggttaagatggctggttcatcatcaacaatcaagatcttcttcatgctgtctcctccgggaataaaatcataccaagttcatggggtgcaccggcaaaaattgcggtttcggctagccgtatctcgccatctgcctgttgaagccgtaaccggcaataagtgggttccttttgaattgcgttataaagttcagcggcattgttgacggcaatatgattgcaggtcaagacccgatcacccggctgcaaatccatttgtgcggctggtgtctgtgggacaaccccgatgacaactaccccgtgattggtttgtgtcacgtttaaatgtacttgatgtgcttgccaaattaagccggcaccgagtatcaaactcaccaacacaggtactaaggcaattgtcatcgcaggcatggtaaggatcgtccagcgccttcncaatcgaaacggaaaaggccttggcgtcatgattcttctcccatgctgaaccataaaagaccnttccgacttcatatagaccgatgtagccgagcgatacagtggcacgaccatttttgaaaagatcgtcaatactatcggtatcggctaaacggtggccaaatgcaccatatttataaagaatcggggcactttccggcgtggcttgtttggttcgttcaatcttgtaaagcaaaccttccttgcagatgcgcatccgttcttcaaaaatcttccaaaacttatctttatcgcctttggactccatagcaatccgcggcaggttaaccgtaataacgccgagattcatgcg

SEQ ID NO: 105 - DNA, 3597 bp, Lactobacillus rhamnosus
ggaaaccaaaagagctttctggtgggcaacagcagcgggtgagtctggcgcgtgctttggcaaccaaggcgccggtggttttaatggatgagccgttgtcaaaccttgatgcccagttgcgaaccgaaatgcgtgaagaaattgcgcggttgcatcgtgaaattggcatgaccttgatttatgttacccacgatcaagtcgaagcgatgaccatgggcgatcggattcttgtgttggacgatgaaaagattcagcaactaggcaccccgctggacttgtataatcatcctgccaatgaatttgttgccaagtttatcggcagcccagaaatgaatctgctgccaattacggttagcgatgaggcgatcgctttagcattggcgatactttctggactgacaatgcgtttgtccttccgtttgacttgccggctggttcctatcatcttggcattcggccggagaagttggtaccggtttcgattgccaacccggataccattacagccaaggtgaagagcttgcaacagcttggcaatgacaccttgattttctgcgactttgatggccagtcattggtcagtcgggtaccggaacagttcaccgtagcggttggcgctgagcttaatttattactgccggctaatgccgatgaatggcatctctttaatattgatgacggtgagcggattgccgtggcgccagttaaggaggcggccgcttatggagcttaataaggaacttaataaatcgacggccaaatcgcaaggcaagctcgccgcaacgattcgggaaaataataagccagcattctggtttttgatgccgtcacttttgatcctaactttatttaccttttatcccatggtcatgacggtgtacaacagcctttttgcaaccaacattcgtggcgaatcagctaagtttgtcggactcggtaactatcttgatattttcaaggatcctttattcctgaagagtctgacgggcactttagtctatgtcgttgcctttgctttggcgaccatcgttcttggtgttattttggcacgtttggcaacgatgaagttacgccggatcagttggttccagacggcatttgccggtacgatgggcaccagtgccgccgctgcttcgattctctggctgttcttgttcaatccgtctgttggcctcgccagttttgccttaaaagcgctgggcgtcaccaatgccaacttgttggttgatccgaccggtgccatgattgtcatcgttttggccagcgtctggatggcattgggttttgcctttctgattcttctgagtgcgtttcaaagtgtgccgccagaatactatgaagttgctgacattgctggttggtcacaattcaagcagacgctcaagattacggttccgatgatttcgccaaccctgttcttcttgtttgtggttgaaatcattgatgggttcaaaatgtttgcccagattgacttaattacaggcggcggtcctaacaatgccacgaatttcctagcatataagatttatcaagatgcctttgctttccacaactttggaacggccagtgcggaatccattgtgctaaccgtcattattgccttggccacttgggttcaattccatttcacagaacggaaggtgtattacgcatgacacatgtcaaacacggagcacgttatcttttattgacggtggttgcggtgatacttttattcccgattctgttggggatttgggcatcgttactaccgacaaaagatattgcggcagggaacttcttatccaccaatatctcgcttaataactattggcaggcgtttgtcaccacaccgattattcgctatatgattaactcgtttgtgaccgccggattaatcaccatcggccaattagttttatgtacacttgctgcttatgcctttgcgtttatgaacttccgctacaaaaagcagttgttctttgcctttttgatcaccatgatgctgccgtttgaagcccagatcattcctaattttcagacggtaaaagcactcggctggctgaacaattatgctggcttgacgattccatttttcacttcagcatttggggttttcatgttgcgtcaagcctttttgcagattccaaccgacttggtggactttggtaagtatcttggccttagccgcctccagtttctttggaaaattgcggtgccatatagtcgcagcatgttgatcaccttttccctttatacgttcctgacccattggaaccaatacctgtggccgttgattacgactttctcggatgatttccggccagttcaagtcggcttgaagcagttacaggcggaagatacgttcgccaactgggggatggtgatggccacggcgatcattgtgttgttaccaaccttggcactgttgcttattggccagaaattcttcaagcgtaatttgaatgcaggggggacgaagggttgaaaaccacatataagaagattattgcgatagtcgcagcgattgttgttattttcggacttggctttttcttcacccaccaacaatcggccagtgctgctgataacaacgggcgcacgaccatcacgttttggcactcgatgaatggcccgaatgaaaaggttctggaaggcttagtcgatcaatttaacaagagtcagaccaaatacacggttaagccgatttacgccggcagttatgaattgtcgattatgaaatatgccaatacggtcggcagtaatgtttcgcctgacttgattcaaagtgatcaggccaaccagtctatgatgatcggcttgaattcaacggtaccggtacaaaagttcattgatcgtgaccactatgatttgagtcaattgtatccaggggtgacagccgcttataaaatcaatggtaagttagcttccatgccatttaactcctccagctcggttatgtactacaaccagagcctgtttaaaaagtatggtattcccgatttgccactgtcaccgacgtatagcgacgtgaccaaggcagcggttgcgttgactcaaaagagtaaaggtgcggtcaaagggatgacgatgcagatctatggctggctgccggaagagttggttgccaatcaaaattcacttgtcgtcaaccacgataacggccgccaagcgatggcaaccagtgccacattgaactcgccggaaatggtcaaaagtatgaattggctgcaagacgtgatcaaacaaaacgccttccaaaactttgggaccggatcagcagctgctaacaaccagagcgcggcgtttttggcgcaaaaggtcggcatcttcatgcaaagttctgctatgttaggacagttacaaacgaacgccaaatttaaatacggcgtgaccttcacaccgcatccggatggtaccaaagcgaatggtgtagcgattggcggcgcaagtctatggattactaaggacaaaccaaccgctgtccaagaaggggcttggcagtttatgaagtatctaatgacgcctaagtctcaagcaacatggcaactcggcacgggctattttgcgggtaaccaaaaagccaaccaagtaaagagcttggctgatgcaattaag

SEQ ID NO: 106 - DNA, 2991 bp, Lactobacillus rhamnosus
  misc_feature (1)...(2991): n = A,T,C or G
gggcaaaagcaagcggcgatatcgctgaatcagctgcagtcaaatatccaagtgacacagccattacgagtgcaaataatgtcgctaagcaagcagctgacgaggcttcagacagtgcagagagtgctaagtcggctgcacaaagcggtgacattccggctgcatcaagtgccgctgccgaagctaagagtcatgctagtcaggcaagtattgcagctgacttggcatcaagcttagctgtggttcatgacaaagacgctaagagctatgctgccagtgccgtaaaatcagctagtttagctagttccagtgccgatgttgcaacggcagtgggcagtcaatatcctgatgatccgacaatttctcgtgccagttccgtagcccaacaagctgcaaaagatgcatcgcttgcagcagatacggcaaaagacgctgccgctcgcggtgatgacgcaatcgcctcaagtgccgctgatattgccaaatctgccgctgatcaagcggaagctgctgccaaaacagcacttaaaacagcagatagtatcgcagccgcaaagaaagcggcggcaactagttttgctggtgatgctgcacaagcggctagtcaggcaagctcaagtgcagatgttgctacttctgcggcaaccaaatatccggatgagccagaaattcaaactgcaacagatagtgcatctgcagcagcggctaaagcttcaagtgctgcagatgcagccagaagtgcagctcgaaccggtgatgatattgctgcttctgttgctgcttctaatgctaaaaccgcagctaccgaagccagcacagcggctgctaaggcaagcgctgctgcaaaagcaaaaagcacggctgcaagcagttatgccaatgaagcaactaaggctgccagtcaagcgggctccagtgctaatgtagctggaaaagcagcaacgaagtacccgaatgactcatcaattggggcggtaactgaattggctaagtctgcggcagatacggcttcgagtgcagctacagatgctcagcgtgccacccaagtcggcgatgatgtgacagcttcacaagctgcagataccgccaagagtgccgcgatagttgccagtcaggctgcttcacaagcaagtgacgcggctaaagcaaaagcaacagctgcgtcaagttttgccgatgacgctgtcaaggccgctggtcaggcgggctccagcgctgatggtgccgtatctgttgctactaagtatcctaatgatccaaacatcaaagccaatacggatgttgctacgtctgcagccaggcatcatactgattcaggagatcattgacactttcctgtttgacggtatcttcattggcatattcattcaacaatttggcaagatcaaatagcacagtcaagccattttgcacgttcacatcatcgtccattgcagcaatgaaacggtcttttaaggttttaagctcagcagtgatctgtgcatcaacgccggcaacagcattggcacggcgatagaccaagttttcccgggcaattttcaaacgatttaagctattagcagcattctttaaattcgcctctgaataccgaatcggcatccgatattgcgtccctgccatgaagaaacgcaaaacctgaggatcgaccgttttgagaatgtcgtggaccgtaataaaattacccagcgacttgctcattttctggtcatcttcgccaatggtcacaaacccgttgtgcatccagtaacgcacaaactgcttgccggttttggcttcactttgggcaatttcgttttcgtggtgcggaaattccagatcctgaccgccgccgtgaatatcaaacgtatccccaagcagttgggtactcataaccgagcattcgatgtgccaacctggccgccctttaccccatggtgagtcccaactgatttcaccgggtttagcagctttccacaaggcaaaatcgattggatcatggatttgagtttcgcgactatccagagaccatgattcattttggcaatgtggtcactggtcatcggatgcaagaggttgctgattttatcaagggttataacgctgctaaagtagaattaactgaacatatgaaagattaatattgagtgcctgtggggattatcaaggtaagttgatgatctaaccatgggctttttattttaactgagtatgcattgttagatgatgaccgagtcaactctgaaaagtatcaatcaccgttgtacggttacgcccacggtaagcaacttgcctcggtgaaaaaccggcatgagaattaaattagactaatgtatacttaagaagtagctgatacaagatggaagtaaacaaagggacaggtagcatggtgttaaaagcggatttttttgatcattatcactacaagaacgagctggctgcactttgccgtgagtatcatttggctgcttccggtaccaaagcggaattgaatcagcgggctaanggaggcaatgntaggtgagcctcctgagaccccaacgcgaacgagcgggccgacagccaaaattaatcttggtgcgatcacgctcacgacgccacttgccggatcgggtttcacgtttaacgcggccgcacgtctttttttgcggcgtattttaagacatctacgtttgcgttcaccaagccaatggcagttatcaaacggcaagtcgagtcacggcctgagttaggattgacggtggcccatctagttgcggtttatcaagcgacgcaaacaccagcggcgcgcaaacagtttctagcccataatgccgaggaacagacttacgagtggaatcgatttgtacgcgacttctttgctgatcctgctactgcgggctatcattcgcgtttgaaagtggccgcgattctttggcagcaagttaaacggacaacggcggtgaaaaagtatcggcatcgtttgttggatcagtatcgcgcggatattcgtgtgtcccggaaaaagtagaaaag

SEQ ID NO: 107 - DNA, 1266 bp, Lactobacillus rhamnosus
aattatggcggcggtcaccccatctttacgcaagacttcgcgaaccttgtcggcaacccaacctttggcaataccgccaaagtcaagccgcattccttttttggttaggtaggccgtgttgtttttggtatcaagcttgacatcgtgccagttaacgagcggcaatgcctgggtaatttcgctttgtgcgggaacacgcgcaccgggcagcccgatttgccagagattggtaacagcaccgattgccatgtcaaaactgccatttgagtttttggagaaataataggccttttccagtagcggcataaaatcttttggaaccttgacaggcttgacaccggcattggcgttgattttatcaagcactgaaccgccacgagtcaaggtagcttcggcgtcaacatgatggatcatcgcaaaaccatcttttaaagctgactttttgcctttatcgtaaatggtaagcgtacatgttgtccccatgacgaattcattacgtgtatacggcgtttttagataggtcgcctgtgctttcttttggcacccggataacgttaaaagtcccatgaaagcaatgagaccgatgaatattttacgcatgttacttaaccctcatttcatttttcccattaacatcataacgctcgttttctaaaaagaaaaacgcgactcgcctcactgtgatttagacgaaccgatattccccgatattagccaagtcaggtttaccatcaacggattaattgggtacattaaaaaggccgacctcagagacgagtttgtctctgaagccggctttttagtgtcttgaataaacaaagaaagttagaaggcgatcagtttggtgccatgaagctccttaacgcctaattgttcgctgatagtagcggcattttggctagtgatgccgccgccgggaagaatcgtgatttgtttttgcgcggcatgggcgatcagtgcctgtagatgtggcaaggttgtttcaattggggttgatagtgggccaccatgcgtcaaaatccgatcaacgtgatgtgcggctagccagtcaatggcggccagctgcttggtttcgggaatggcatcaaaagccatgtggaagacaacactcataccggcgcttgctgcgatcaaactcgtcatggcatcttcatcaattgtcccgtccggcagtaaggcaccgaatgcaacgccatcgacgccaagtgcctgcgcctcgaataaatcggcttccatgatctttaactcggtgtcattgtaaacaaa

SEQ ID NO: 108 - DNA, 1268 bp, Lactobacillus rhamnosus
caaggtgttagcgtcctatcagtatcgaaacgcttaggccatagtaacatcacaacaacacaagcaacgtatttgcatgtcatcaaggaattggaaacacaagataacgagaaaatcctatccattttgcaagcaatttaattggcacatctcttggcacacaaatgggcgatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctaagaaccgaaatttgatttttgctgtattattgacaggtaccctgatttcgtctttactgcaaactgcgctgacaaccgcattacccgatatcatcaagactttcggcgtaactgctaacgccggccagtggctcaccagcggcttttccttggccatggggattatgattcctgcaacggcatttctgatcaaaagaattccgaccaaggccttgttcatcgccagcatgctcttgtttgctggcggttcactgctggctgcacttgcaccaacttttgccattttattggtaggccggattattcaatcactcggaaccggtatcctgctgtcgttaacgcaagtcgtcattttaactattttccccgtttcgaaacaaggtggcattatgggcatttacggcttggctgccagtgccgccccgattattgcgccgacgattaccggcctcttaatcgattacatgagctggcgggtcatattctgggtcggcgtcatcgttgccgtagcggatattatttttgctttaattgttatcaaagatgtcttgccgaccgaaaagctgcaatttgactggcagtctttcttgctcatcagtatcgcctttactggtattaccgttggcttcggtaatcttggtaccgcaccgtttctgagtttggcaattgccgcgccgctagcgttagcagttgtggccgggatggcatttatctatcgcgccttgcatgttgatcaactattacttgatttacacgtctttaaagatccggtcttccggactgcagtaattctaagcgcgttaatgtatgccgttctcatggcggtttccaccgttttcccgatctacgcacaaaccgtccatcacctctccgccaccatgtctggcctgatcatgatgcccggttcgcttgccatggcaattatgagcccgatc

SEQ ID NO: 109 - DNA, 592 bp, Lactobacillus rhamnosus
  misc_feature (1)...(592): n = A,T,C or G
tcaagtgctttctgtatttggttttgattcggcaaagtttcctgacgcttggcgatggtgctaagtagctactgtnnncagtggatcacgcaattcaataacgttacttgctgtatttagtcatttttggccgacttgttttgaccttttgttccagattctgctcaggtaggctggctggctcttcgtgaaacagacggggcaggtggcgtggcgcaacagtcgatactgacgtgacaacctgttgaacatgctggtttggctcggtggtgggattgacggttgttgcggccgatccgctgctagtcaacaaccccgcggcaaccgctaaaaatgtaaagaccatatgcaaaactcccttcgactggctgacattctttaataacagcgattaacagtcagtctagtaaggagatgtgattgatttgccgcatttgtgaggtcttttcacaacgaaaatgaaacgaaaacatggtgattcgttaacagaagcgtaaagcatggcgaatatggaccaaaagttgaagaagtatggatgaatcacgcgccgggcagtaaaaaattttgaacatgaaaaaagaccactcgggta

SEQ ID NO: 110 - DNA, 1349 bp, Lactobacillus rhamnosus
  misc_feature (1)...(1349): n = A,T,C or G
ctgacgacagctttcagcattttcttgattggctggctgttcacattgtgtatacgttaattggcgtcatggtgttattttgtgtctttagcttttcggtcttgatcggttgggtgcttgcagttgccagtgcggtggcggtgtatgtcgtggcaaatcggcgaccggtggcaccttaccagtcgcggaatcgtagtgatcagtccgatgatgatgatatttggacgatgccttcatctggacaagctagtccggtgcctccgtattcgacgcctaatcgtcagccaaatttttcacctaattcccaaagtggcggttcgtcgcgttggtggctgcaatttgccggaaaatcacatcggcgcggcagcttgatctggctgatttatttagcggccgcgtttcttgccctaattgccgcttatgcttggccttttggagcgagcggggttggtacgacaacggtgggcggcagtttgtatgacttggttcgcagtgccagtacattggccgaaacgacggctgctaccactgggacagtgggtgcggcaaaggttaatctgccttatgtagcgctagcgttggcaggtgtggggccagctttaggattagtgtttgggcttttccgggcgcgcggcatgatgcgacttggcgggatgttagggttactgggctatgcggctttatatgtcgcctatgcaccgttaatgagcagcggaacaaatcaaattcaagggttgctcaatcctggcattggctatgttgtggggatagttgctgcattagtgatggtcgtcacggcacggcttttgcgacgtgattgacgcgtttcgcaactgaacgtttgttgcgataaaataaaatatgttctgtattggtgctgagtgttgtacgataaagaagtccttcacaagangcagttatggggtaagggtttgaaaccgaaacaaaggaacgtattggcttgggttaaggtgcacaaccatgcaacggcgtaagcgaatctctggtattttaatcactgctttgatgatcgcggtcgtatttttgatctggtgggttccatctttggcaccttcaaaatcgggtcaatcttcaacgtcagcgccacgacaggtgacatcgtcgtctgcttccaaaattgttaaccgcagcaccatcagcgcatcaacttcatctgagtcgagtgtcacgtcaccacaagcggctagcagtctcaacgagtcaagtttcttttcgccgacgctgaatcgttcctggcgctattttacgtatcttccggctggctatacctcatcgcgccagtatccgcttatcttgatgctgcacgggatggatggtgatgcaaccaa

SEQ ID NO: 111 - DNA, 2354 bp, Lactobacillus rhamnosus
  misc_feature (1)...(2354): n = A,T,C or G
gatcaatgttgcgaagatgcaaaaagtcgccatctcgattatgaaatggcgactttttgtgtacgggttagaattcgcgttttttatacagcacggtgcttaaccaccaananaagatgaaagctgaaataaagattgccacaattactccgaaccaaggcttgagggcatctaagtctacttggaagcttctttcaagaaagacggcaattaagagaatggcaagtggaaaataagcagcaagaggcgcgcgcttaaaccccaagccaatcatgagtggaaacgataagataatttgaaagagcatgagcgcagtaccaaaacaaagcatccacccgaaagcttgtgaatcacggattggattaacgcgagccatccaacccagaccaatgataagcatgctgcacgcgtcaattaagcccactgtcatcaaaccgaacagataatggccggcgacaatggtagtacggcggaccggtaacatggtgtaaagattctccattccttggcgatcaacaccgacaaaaggcatcatcaataagccaatgctaagacccgtaatgccgcctgcaagcggggttgctaagtcaccgttcaagaaagggagaagcaacaaaatgatactgatcaaagtaccaaaccaaaaatacttcttactattagtatgaaatacagccagatccaagccaacaagtttgaccaaatcacgcatgtgcacgcctccctttgccaaaagcaatcatcaaggtttccaaatcaactgtttcctgaacaatactgtcaggcagttgatcggcttgatcggcaggccaaataccggagaatccgacgcggctttgttgcaatccgataatcgttgcttgaatgcccggggttaactcacttggaccacccttaatcatgatataccgatcaagcaggtcacttaatggcccagtgaaggttactttacctgctaacaagtaagtgacataatcggccactttagccaattcgataatactgtgggttgaaatcaaaacgctatgttgatcgtcgctgataaaatcctgcaaaatggcaatgagttcatcacgggcaatcggatccaagccagacgttggttcatctaagattaagagctgcggatgatgggctaaagccgcggccagttgcagcttgattttggtacccattgataaatcacgatatttggttttttcaggaatcgcaaaatcgtgacataactgtttaaaataagccgcatcccaactagggaaaaaaggaccgacaaaccgattcactgcggttgattgccatgagtctggataaaccatcccatccagaacaacaccaagctgatcccgaacctgttttcgagctgcaacggtggtttgacccagtaaactgatatcaccactgtcaggttgaagcatgtcgagaatcgctttgatcgttgttgttttgcctgcgccatttggaccgatgaaacccataatataaccggcaggcaggtgaaaactgacgtcagccaagtgaaaatcctcatagtgtttgttgaggtgcgaaactgtgagtaaatcagttgtcatgatcggcttctccttctgcttgcagtaatgtatctaacatagtgtgcaactcggcgggggtgattttggccattttagccgtgtcgattgcttgagtcagggacgcttcaatgtcgcgcagtgcgttttcccggaccaaagcgctatcttggcccagaacataagcgcctttaccctgaacgttggtaatgaatccggctgcttcaagttcgtgataggcgcgggtcgttgtgatcacgctgatacgtaaatctttagcaagactgcggatagatggcaattgttcattcgcctttaactggccggcgaggatcgcggttttaacctggtcttcgatttgttcataaatcggtttgcccgattgatttgagatgacgatccgcatggttaacctcatttcgtgtcatgatttgaccggatgacgcttgcgggcggtacgttgtaattgtaacgaacgcttgaacgctttgaaaatcccgccatcagaatagcttaacacattcgtntgataaagcttgaccgttagccaggtgaacgcgattaaaaagatcacattaatgccgaatgctgaccagccggccgcagcactgacttggcctgntcccagtngnacgggcatcatcatggttgataaaaatggcacataactggcgatattaanaataggcgaggcgccattggcaacaatgatagcgccaaagtagccaaccattcccagcatcacaatcggtgtggtagcctggccgatccaaaaaattcaaaaagctttttgagagtactttt

SEQ ID NO: 112 - DNA, 1027 bp, Lactobacillus rhamnosus
gatcaaaatagcaatgccggaaagcagtacgaccagataaagtaagaattgtacccagctggtcggcagtaatagattaaggcgtacgccaataattgccccgacaaagctgccgccgctgagtagataagcgacccggcgatccatgagcccttcatgttgataatgacgcgagcccaaccagccggaaataatgaaagccaggaaactgaaggccagaccttccgtagtgctatagccgagtcctgcggtgtatagaatggggagtaaaaaaccagccacgccagtcataccgacgaggccgccgattaagatgttgccaattgcgatgatgatgattgccataatgttgggtaacgccgcgcacacgcagctttaatcctttctacgtctaatgttaacacttctcggttccgcatcagccatttgccggcaaccatcgaatccgcgacatcattagcattgacactttcaagcaacgtgttattccagttgccggttggccaaaggtgggggctatcaatgtttaacccgatgatatcagcctggtaacccggtgcgattcggcccagatgaccggatagattcagagccgccgcgccaccatccaagaccatggacataattgtcggggcaggcatgacagcaggctgatgttgcaaggtgccataatgcagggtcataacggcgcggaaaatcttcatttcctgccacagactcagaccgccatgcgccgcgccatcggtacccaaaccaattgaaacacctgcatgtaataattcaggcgtggcagggatgccttttccggcgttactgaacggactgtgactgagcttgacgtgatgggtttcgatgagcattttttctgtgtcgtcaagaaacagactatgtgctcctagaaaatgatcgcttaaggcgccgcgttttgcaaggtagacatatggccgctcaccgcaacgcgctaaaataccggcgacttcttgaggatactcgttcatatgcgcttcaagaaaagtctgacgatcct

SEQ ID NO: 113 - DNA, 611 bp, Lactobacillus rhamnosus
  misc_feature (1)...(611): n = A,T,C or G
gatcattactagccaaccgttccgcaagttcctttgagaccgaaccacgaccactgacggcaatcccgttggcagcccgaccgataaagctgacatacccgtctttaagcttaatggctgacgccgggatggtcacactaccacggggttgcggcggattctgccattgattggcatctgcccttccgcacccccagccaatgattaaaaaaaggccaacataaacgaaactggttcgattggttttcatgacaagacaaataagcaagatagccagcacccaccacaaaccgataccgcccatgatgccggcaagtaaagcagtcgcaagtaagattaaccgcccgctcatgggcccacggttagctgcggcgccagggtttcaaaagtcttatccccaataccatgaacttctttgagttcgttaatatccttgaacccaccatggctgtcgcgataactaataatatccgcagcctttttggggccaatcccactgatggtngtcagttgcgccacatccgctttattaagatccaanaaattcaaaaagnttntcnagagtacttttagaacggccgcgggcccatcgattttccacccgggtgggg

SEQ ID NO: 114 - DNA, 797 bp, Lactobacillus rhamnosus
tgaacgcaatttaccggacttagaaacagtgactcaaattgcccggatcttttcggtgtcgcttgataccctgatcctcgacgattctgagttaaacgaaaaattgattaaggatagtaaagtgagccggcatcagcttgttatggctgttttgatgacggctagtctaatcatgactggagtggcagcgacaacattcttgggctttttccctcattggcttgcgcaggttatctggtcaatttatgccatcgttttgttaatttggagtcgggcctctgatccaaaatcaacagatatttttgcaagttggtctattacaagccgtttactcatagccacctttttttctttaatgggcttgatcttttgcctaacagcgttatatcttatctggtttcggggaattgatgtacaaatagtcttggttctcatcggtggcgcaggtttgctcatcctaacaaaacccgtctggccacatcgtcagcatgcaaaataagcatgtgcgagtacttctcaacgcgtgaccatcttgcgcttgcgtatgtatcccagttcaagtgccacaataacaaccatcaccatccctactaacgatgaaacggcaccagaggcttctttctccagccacagactcagtgcgaagaaaacagcggcggtaattgctagtgttgctagttttataaaacgaatccgcgtcatttttggcttgctaatgagaatgctgctaataaggacgaaaacaagtgtaaccattcggcataggttacctaacaggatcatttacatcactgcct

SEQ ID NO: 115 - DNA, 736 bp, Lactobacillus rhamnosus
cgatcatttcctgagctaaggcatcggcgacaatttgtgcttcactgtgatgttcggtctcatcgcgcattgcatcaatgcccgccgccagcatccgccgtaaccagataaattggcgattgcgttttggcggtttagggacgcaaaacggcaatacgatgaccggaacgatgagactgaggagaatctcaacagccgcaatgagaatgagtccttggcgcagggcaaaatggtgaccggcaactgtttgcgggatcgaaaaagccagcgataaagtgatggttccatttgcaccaccgagcatcatgatcaacgcattgcgccatcgatgtttcttgcccattttcaataacgtccgactccagatgaagcgaacaaaggatttgaccacgtatatgaaagcaccgatgccaatgagcaagccgaataaccctgcctgcccgcgtaatgcctcgatcacaacatttggcagcgaaacacctaacaaaacaaaaaccagtccagaaagaaccgcagcaatcatttcccacacattggcactgataatttgcatccgggcgctggtcagccgcaagcgatcacgctcaacgccttgggcaattcctgcagccacaactgctaaaatgccggaaagtgccagttcttgagccagaaaataaaccagtaaaggcgtcagcaactgaattccgaccataattaatggctcatcatcaccaatgcggattagccaggctct

SEQ ID NO: 116 - DNA, 720 bp, Lactobacillus rhamnosus
gacttgccatcaaagctacttccgggcagtttcaattttgatcagctctccaatggcctgcctaacctgtacatgggcatgatcggcctattaggtgccagtttttatttccttgcccggacgattccggttcgcgaacgcttggtttcggccggcatgacgttactcttgatattatccatctggctcaatcctctcgccattatctggcaagggttccgcgcgccggtgtggtatttataccgccactcattcattgtcattttctggttcttactactcagtctccgtggacttatgcagttgcgagccgtgtctcggttacgtttaatcctcaccagtctagtcgtcggcgggctgctcatcatccccgcggccttgcgcatgggaacacacaaatatgtcaccttaccgcatctgatcctcgccggcatcctgctcctaaccgccgccgtgctgctctacagttatgccacccgtctattctcggtaaaatggacggttggtgcacttttgaccttgcttgtcatcgacttaggcgccaatgcctatgccagccttggcgccatcagtttcatctccaaagccgacttcaccgtcaccagcaaagtactgagtgctgcttacaacgacgccaaaaaaatcgggccatccgggttctatcgcattaatgcagacacccaacgctccatggacgatccctaccaatataatttcaac

SEQ ID NO: 117 - DNA, 407 bp, Lactobacillus rhamnosus
  misc_feature (1)...(407): n = A,T,C or G
gatcaaccatgatatctttggcggtcttgtcgtttaactcgaatgcccgctgnatgtagatgacatcgttttgttccatatcgcctgatgttacggcgtttttactaagactcaaaatttcggcttgcgaaaaagcctcgttaccttcatcagccggcttcatgcccatcattttgacaatggcggtcgcactgacattcagtaaccagacgaaggggaagaacaaaatgtggaaataatgcaaaggggtgacaactaacattaacgttttaattggatagtcaatcgaaatgttttttggcacaatttcggtaagcaccacttccaaataagttaaaataatgacccctaaaactgcaccaactgcatgtaaactaccattaggcaagcttatcgataccgtcgac

SEQ ID NO: 118 - DNA, 1208 bp, Lactobacillus rhamnosus
gatcgacaacaacaccactgcatgctagtgttgcttccgcacccctgtcttctcgaggaccaacttgaaagcgagtgatatgctcttgtccttttcagtaaattggttaataatggcgattttccccctatttctcagtatctgtctttcagtttattctggatacttaaggaaaaagtttaggattaatcctattagtataaaaaaggctttcaaaagttccgatgatggttattttcgattcagagaacaaaataattctaaaataggcaaattggcgtatttgcaaagaatgatgctggttattattggactcggttacttcattagtttggccttcttgctttcaattttttgggaactctttaacaggcatcctttaataagaaccgctcccttcgccttatgtgctgtgtctttaacgttggtatttgatattcttcttcaatcgactagcaaaaagaagttgatactccaaattatggaataccaacatcttaaagcgaaagggtcactaactgctccggttaaggattttttcggatcaaaacagcctttgattagcatgagactgtttactctgggaatgaccagttcggccctcttgatagtttcctttttctgcctctttattgatctaacgcagcctctatcccgttaaaactatccaccaaaatgttgggtaattttttcacggtgaattgagttcactgctacgaactgtcaaacttcctttgagtatggcaatctattcttgttatttagacatttctagaggatttcttcacagtattagtttagatcaatattattcctgacactgtccgcctggtgtattctcttgattttggttcggcctttaagcttccctgacgttcttaattttaaatcattgtcttcattaaagttacagatgctgacaattgacatactccaaaagactctttgaatggtaaaagcagactttgttaccatcagaaaattgcttcccgttattttttgatatcgctcgaaaggtagtgacgtttctatgttttcactatatagttgggttatttatgccatactgtttctcatcgcaagcttttgctgtgccttttattcactctttatccggcacaagtttaagctccatgacagactattaacgaaagtatttggtgatcccctccataatccgtatagattcctagaaaccgaagatgatc

SEQ ID NO: 119 - DNA, 2323 bp, Lactobacillus rhamnosus
  misc_feature (1)...(2323): n = A,T,C or G
ggtacacttacctngtaccccacccgggtggaaaatcgatgggcccgcggccgctctagaagtactctcgagaagctttttgaattctttggatcaggttatcgttcctgtgaccctctcgattaaacaaacaggaccggcaaattatggtcataaaaaggacaaccctaattacatcgaaaacatgtggttgaacatcccttatagcatgagcagccaaaccgataccattttcgataaaaacaaactcagggttaaaccagcgatgcatccttcaaccgtgcgccaaccattaaccttgcagttctcagcaactcggacaagttatgatcatcgcaaccaaaaaatgcgcttcagcttcctcgtgcccgttaagaattatcttgtgaagtattcgttgttgctggaatgatgcggctgattagcgttgagtacgtctaaagcaattctacaaaggctgtaatcattgcaaaattcccccggtttcttcccttcccccagaagcgtagaatggcgttatacatggagaagcgtaaaaactagaaatggggaacagacatgaagaaatcgacgcgcaccatcctgattagtgtggtcgcagcaattgtcgtcattgtgggtggcttcggtgcctttcactggtaccaaggcaaagctgaaggcgaccaggttaaggccacggcccaagcctacacgaaagcttttgccaaccgccagtatgaaaaagccgttaaacaagtcgacactagccatctcaaaggtccgggctggcaatataccgccaagacgttggctgaacgcaatcaggccgttttcgaccggatcggcgccagcaacattaaaatcacggatctgaaaacaaccaattccaaagacggtacctatcaactcacttttaccgccaacatgaacaccaagatcggcaagctcccggcacagcattacaccgcgccgatcgttaaagtcggcgacaactggcgcattcgctggacgccaagcctgctgtttccacaaatggatggcaaggacacggttcagattagtttgacagctgccacgcgcgggaaaattctcgatcgtaatggccaggcgctcgccaccaacggcaatgtcacccaagccggcctggtccctggcaagctgggcaccggcgatgaacggaccgctaatctagaaaaaatcgcgactgcctgggatgtgaaaacctcgagtcttgaaacgctcctcaagcaatcctgggtcaccgatgatacatttgtgccggtcaaaatcgtcaccgactcccctgcattaaccggtgcagcttaccaaacaatcggttcacgtacttatccgctaggcgaggccgctgctcaactcgtgggatacgttggtacggcaaccgccgatgaccttaaaaagcatccgtcactgaccgccaacagcaaaatcggtaaagccggtttggaacaaatttatgaccattacttgcgcggtacggatggcggcacgatcgcgattcgcaacggcagcaatagtcatcccttgctagacaccaagccaattgccggcaagaatctgaaactgacgattgacgccaccaaacaaaaaaccgcttatacccaactagcaggtaaaagcggcagtgtggtcactatggatccaaccaacggcgaacttttaactttagcaagttcgcccagctacgatcccaatgccttcgtgaacggcatcagccaaaccaactatgacaaatacgccaacaacactgagctgccattcctcagccggttcacccaacgatacgcaccgggttccacttttaaaatgctaacggctgcgattgccctgcaaaacaaaaccatcacccctgacacaaccaaatctatctccggtctcaaatggcaaaaagatagttcgtggggcgactacaaagtgacccgcaccgttgacgccagcccggaaaacatgacccaggccttggttaactccgacaacatctggtttgctcaagtagcactgaaaatgggcgcctctgcttacctcaaaggtctggagccccttttcaaaacccaagccaacttacctttaaccatgaaaaaggcccaaatctccaacaatggcaagctcgcctccgaaacgctcttggccgacaccgcttatggtcaagggcagctgctgctatcgccaattgaacaggcggcgatgtacagtgccatcgccaatgacggcaccatgcagcagccaaccttgattcaagctgcaaaaggcaaacgtaccagcgtgctccaaagcaatgctgccaaaacggtcaaaaccgccttgacccacgttgtctccgatc

SEQ ID NO: 120 - DNA, 3613 bp, Lactobacillus rhamnosus
  misc_feature (1)...(3613): n = A,T,C or G
gatcaaaatctttgatgctttttttaaattattacacctctattagtttacgtgctggcctgcaaggtgtcaactggaggcaaatttagtgagcgcgagccagcccggttagaaaccggagcataagtggccttgggcgtaatgaccgggctttggtcattgcgaccaaggtccttatgtgcaggtttctgggctggcgagcgcgttatgggcgtaaaacagaacataagtggcctcaggcgtgatgaccgggctttggtcattgcgaccaaggtccttatgtgcaggtttctgggctggcgaacgcgttatgggcgtaaaacagaacataagtggcctcaggcgtgatgaccgggctttggtcattgcgaccaaggtccttatgtgcaggtttctgggctggcgagcgcgttatggacgtaagccagaacataagtggcctcatacgtgatggcccgattttgaccattgcaatcaaggtccttacactccgattgccgcgactacgaacgcgttatgaaaagcgtgagccattttcacacccgatccgctcgcaacacaacaagcaccccttttaaccagtcatgatgcggcagatgtggtagtatctgtctctatgtctgcttgatcgataacgtgatccggcgacattccataagcaagccggacttgtttttcaatggttcggcgcagctcctcatgcgtttcaagatagcttttagcgtgctcacgtccttgaccaatgcgctcgccttggtaggcataccatgaacccgccttttcaatgatgtctttttcaaccgccatgtcgacaagttcaccgctttgggaaatgccttgaccatacataatatcaacaatggcagtcttaaacggcggtgcaactttatttttaaccactttgattttggtgcgattgccaataatatcggcaccgtttttgatctgctcggaacgacgcacttccatacgcacagtggcataaaacttcagcgcccgaccacctggcgtaatttcaggattgccgaatacaataccgactttttcccggatctggttgatgaacaaggcaattgttttggttttattgatcgccccagacaactttcgtaaggcctgtgacattagccgtgcctgtaacccaacgtgtgcatcacccatgtccccttcaatttctgcgcgcggtaccagagctgccactgaatcaaccactaaaatatcaatggctcccgatgcaaccagctcatcggcaatttccaatccttgttcaccggtatccggctgtgaaagcaacagctcatcaatattgacgccaagtgccgctgcatatttgggatccatggcattttcggcatcaatataagcggccgtgccaccgtgttgctgaaccatggcaactgcatgcaaggccacagtcgttttcccggaactttccggaccatagatttcaacaattcgtccacggggcagcccaccaacaccaagtgcatcatcaattgcaagtgatccgctggaaacagcagaaacccgtgtctccactttgtcccccatccgcataatggcccctttgccaaaattcttctcaatcttctttaacgccgttgccaatgcttcctgtcgttcggtttctgccatctcttaccgcctcctgtttaatgagcttgttccatccacaactatttgctgttattcgcgtaaacgcttcaacaccatcatcatccccgtcataacggcgcgcttgcggacgtcatttcgcccacccggaaaatgataaacctgtgctattggtttctcccctaactgcgccaaaccaatccagacggtgccggctggctgtccttccagcctgtcaggaccggcaactccggtaaaactaacggcaatgtctgccgccgctcgttgacgagcatgctctgccattgctttggcagtaaattcactcaccacaccatgttctgctagttgacgggcatcgatatttaaaaatgcagcttttgtcgctaaagcgtacgtaacgaagccgccttgaaataagccgagaccccaggaacgtctcccaatgccgcttgaaatgcacctgcagtcaggctttcagcggcactaatttgcttatcactagccgccaatgctttgactaattcctgagcaagactgttatcgtcaccgtagccgtaaaagtagcgaccttcacgatccataatgatgccaatcattggctcaagttttgccgcggcttctgcttgtgttttgccactcgcagttacccgaactgtcacctcatgatcttttatataggttgcaagtgtcggattcgtctggttggcaattaaatcacttaagtccgtcacaagttgcgattcgccgataccaaagaaacgcatcacgcgactttccaaaacttcctgatgcccgctatattttgccagtcgtggcaacagttcatgatcaaccattggcacaaactctttaggtggtcccggcaataaaacataggcgtgttggcgctgctcaacccatgcgccgaccgccaacccgacacgattggccagtacgattgcgccttggggatacatcgcttgcaagcgattattgggtgtcattggacgttgctgttgtttaacccgcgcagccaacttggccatagcgccagcgtcttccaccaagggtaaattcaggtgtgcggctagggtttgcttcgttaaatcatccggtgttggtcctaaaccgccaatcaaaataacgatatcactgcgttgttccgccaaacttatcgcgtcagccagtcgttttgcgttatccccaacaacctgttgatgatagcttgcaatacctaatgtagccagttgtttagccatatacgcgccatttgtatttgtgatttgtcccatcagaatttccgttccgatagcaataatttctgcttgcatatttttcccacctaacaatagaattcgatgtttagcacatctgccctttaatgcattcactcaatattcaaaaattctgctgccaatctgctgcgatcacccaaccattaacataaacaatgcctccaagcccaacaaggttcagttttattttactacccgttccgttttgcgccgaataacgggcacaaaaaaacccaagccatcagcctgggtaaaaaacggtattactgctgtttagatccaaatgaatctgcaaaaacgccgcgattcttgtaaaaatattccacgccagaataaatggtgaagaacactgcaacatagaaaaggattagcgcaaacggaatgttaatgttgttgaaccatgcgttattgagcatcaaaaagatgatcgcaaacatttgcgtattggtcttaatctttccgggccaagcagcagccagtacctctccttcattggaaagcaatagtcgcaatcccgtcaccgntaactcacgccataggataatcgccgttccccacgctggaatctgtccagctgctgtcaggaacaaaaatgcggtcatgactaacaacttatcggccaacggatcagcaaattttccaaaattggtcactaaatgtttgcgccgggcaatctgaccatccgcaaaatcggtaagtgaggccacaatgaagataatcaa

SEQ ID NO: 121 - DNA, 1065 bp, Lactobacillus rhamnosus
  misc_feature (1)...(1065): n = A,T,C or G
gctcgcgcccctgcaggtcgacactagtggatcctgttccttggtgttcgttgttaagtgttgggcggtcacgcctttacttgcagcgaaaacatccttatcaaattctttgtgtgacgtcttaaccaacttcttnaaccagccattaccaccggtttcaaggttcaaaccattatgaaacacaacatcggcttcactggttgccgccacatcggttgggcgcggttcatactcatgcggatccgtgccgcgtttaacaatactgtacagcttgatccgctcgccgccgacattttgaaccatatcctccaaaatcgaattggttgtgaccacccgcaacgtttgattcgtgctcgctgaatctttttgagccgtgctccgactgttaatgaaccaaaagacaccaccgaccatcacaattaaagcacctacagtaattaaaatcttcttcatcgaataacttcctccgcggtttgagtcgtcgcggctgttttggtccgctgacgcttactgaaactaaagaatgcctgttttggtgaaaagacgaacgagatggcgaacaataccgccgctacgagcacaattgccggaccggatgcccagttaaaggtgaagctgaaatacaacccggtgatagacgaaatgaccccgacgcttgctgccatcacgagcatggtttcaagccgatccgtccataagaaagcagtggcagcaggcgtgatcagcatagcaacgaccaaaatgatccccaccgtctgcaaggccgaaacagttaccaaggttaaaaccagcatcaacgcgtaatgaatcgcagtggtattcaacccataagttttagcaaaggtattatcaaacgatgtgatcaacaattctttatagaacaacaccacgaacaagatgacaatccctaacacaaccgcggtggtcataatatcactatcgctgaccgccaaaatattaccaaacagaatatgatgcaagttcgtagcgctttctgccatcgaaatcaaaatgaatccgagcgcataaaacgcactgaacaccacgccgattgaggtatcggtt

SEQ ID NO: 122 - DNA, 560 bp, Lactobacillus rhamnosus
  misc_feature (1)...(560): n = A,T,C or G
gatccctagcaattactgaatgatcgttcatatattcgctaataattatcatttaagaagtaatataccggagaaaactttatttataaaataacaattattatagttccgtttacgcagttcatcttgttacgcttaattcagcaacaagtgaaaaatgtaacatgaaaggaggcacccgattgcctaggaaatggattcatatgctgatgttactgctgatgctggtcacgcaaattggcagtgccgcggtcccggtagccaaaagcgctcagactgatccgaagcacgatgtccgggatgcgtcagtgcagccgagtactcgttctgttgcatccnaagctgctgagtttgatttggaagcagcggctagtgcgccatcaaccagcgcggccgccaagcaagcgacttcaaaagatcggcagcacatccagctagaagcaggaaaatcctggcntggcgatggtcacacgttaacttataactttgacgttcaacggtctgaaattcaggttaagttgattttagccaagccacaggatcaaacggggcagcaagtc

SEQ ID NO: 123 - DNA, 507 bp, Lactobacillus rhamnosus
  misc_feature (1)...(507): n = A,T,C or G
cctgcaggtcgacactagtggatcgtgatgttccttgcgtataaagagattattcacaacaaagcccgctatctgctcgtcatggcgacctttgttttaattgcctatctggtctttttcctaaccggtttggctacaggtttagcgcgtaacaatcgcaccgccattgacgcattaccgggtaattacgttctcctgtcaaaatatgccaacaaaaatcttctgagttcgacattgagcgcggaccaaatcaccaaagtcagcaccaagcacaccgccgtcctcngccaagtggcggttgttgcggaaagtaccgcgaatgataagaaagtcaatagtaacgtctttggcatcaacctcaacggcaagctgaanccaactgtcacaagtggacgactaccaatccatcacaacgaggtacttgcggatgacagtgtgaccatttatggtttgcaccaatgtgatcgcatcactttaaacggcagcagtcaaacgtatcggatcgtc

SEQ ID NO: 124 - DNA, 2341 bp, Lactobacillus rhamnosus
cagtttcacatcactggtgctgagtccggctttcttgagtgcctggatgataaggtactggcggcagtgcctttttgatacgcaatggtcttgccctttaattgctcaagactggtgatgccgctatttttaccaaccaaaataccactaccatattctttggtggccccagcggcaattagtgcaatgtccgtgccagttgctttggcagttacaggcggcgtatccccgacccgcgcatagtcgatggcaccgcttttaagtgccgtcatcaaggctgccccgtcagagaactccttgaactcaacctgatagccttttgctttcaactttttggctaattcgccgcgctgccgggcaatgtcgacaggatcggctttttgatagccaatcgtgacggtctcaaggttgctcgatgccgtggtggtttgcgtataaccgtaaaccgccacgctcagccaagcgactaagcccactaacaataaaaccagtcgtaacttacgcttcatatagcttcccgccttgcattagttgtttgcggagtttcggccgtagtaccttaccagtagcattcaccggaaaagctttgacaaaaacgacttcggttgggcattcataagcggctaaatgtcgacgggcaaaattgagtaaatcaagcttggccttttgcggatcctccgtggcgtcttggcgaatcacaacggctgtgaccgcttcaccgtataagttatccggtaagccgataaccgccacttgggcaacccagtctagttcgtttaggacattttcgactttggccggggctactttttcaccaccgcgattgatcatttctttgcgccggcctttgacaaacagatagccgtcttgatccagatatccgaggtcaccggttagaaaccagccattttcaaaagattccgggtgcggctcaaggtaatcatgaataacgtgatcaccgcgcagaacgatttcgccttcaacaaatggctttttggtaaaggtgccatctgctaatttgattcgcaactcagtccccaccggcttaccggctgaaccgattttcggggcatgaatcggattaagtgtactttgactagccgtctcagtcatgccgtagccttccagaacctgagtatgaaaatgcgattgaaaggcgaccagtttatcttctggcagtgcaaaggaagagctgcggacaaagcgtaaatgaatgttgctgtgataagccgctaacgcctgttgattcatcagcaagattgaaatgatcgtcggaaccaccgagacccatgtgacatgattggtttcgatcgtcggccagaatcccgaggcggaaaacttcggcgcaatcaccagcttgccgcctgacaacctggtagcaagtaccgagatgacctgggcattaatatgaaacatcggcatgaccaccatcgcggtatcatccggcgatagtgcgtgactcttggcatcatgaagcgcagcatttaacaacatccggtgcgtcaagccgactcgtttaggtttgcccgtggtcccggaagtgttgaggatcaatgccaagtcgtcttcttgcggtcgtgcttgaggcgcattaatccgataagccaactgactggcatcagtcaggattgccaactcaggaatggtatgcagctgtagcttctcccatggaactagcggggcttctaaggctttacccacagtcggtaacgtgataaccgcttgatagtggtaagtttcccattccgtcagcaattccggtagcggggttttggcagcgatcggatgggcaacagccccaatttcccagagcgcctgattaagcggtaaaaagaccggcgaattcggtaaagcaattaagacttggtcgcctgcgccaattttctgctcagcaaactgatcacgtaacgcggctacatcttcttccaaatcgcgtccggtgtaccaagtattggcctcaacggatttgactaatgggtaatcacgatgattgatgagattctgagataactgatcggtgagtttgctcatgattcaggactcctttcgtagctaacaacaatgactgcggacggccaatgagccatccaaacggggaaactttgtaacaaaaccaagcgatggcaaaggaaatgccgagaatgctgagataacccagtggcaacagcagcattaacatgagattactaagatgaaccagtcccaagacaccacctaatagcgtgatggcaatggtttggcaaagatagacaccaaacgaaacttgtgcgccatgaccaaccaaacgagcaaaccagtgcgttggctgtttggcgtgccacctggcatatttttgaccaag

SEQ ID NO: 125 - DNA, 2003 bp, Lactobacillus rhamnosus
  misc_feature (1)...(2003): n = A,T,C or G
cacttacctggtaccccacccgggtggaaaatcgatgggcccgcggccgctctagaagtactctcgagaagctttttgaattctttggatcggtaagccgcgacatcaaatgagggacatatgatgaaaaagacaagtttctggcgtttgttagggtttatgggcgcgattttattgttattgaccgcctgtggtaagcaaggttctgcggcaaagtcttcgtccagtgcgccggttaaaattacatactggcaccggatgaccgggacttatgaaaagtcgctgaataagttgattaccaaattcaacaatagccaaaagaagtacaaggtggttgcgacctctcagggttcatacaacgccttgcaacaaaagatcatggcggcaggaaaatccaagacgctgccaaccatggcccagtcaccctatacaaatatcggtgactatgtgaagaatcagttgttgttgccatttgattcggaaatgttaaatggttcgaataaattaagcaatcgtcaattgaaagatatttacccaagctttttagcggcgggcaaatacgatggtaagtactatgggctgccattttcagtttctacttcggtactcttttataacaagaagttgatgtcacagtataacatcagcatgccaaagacctgggctgattttgcggcggatcaggataagctaaaagggaccgatattaatgccatcgagctggatcagagttatgatgtggccttggaagggatggcttatggtgctggcagtcagctgattacgccgaagttgaaggctaacttgaatgcaccgaagacattagccgcggtgaatcagatccttgatttgcgcaagagtggcgcgttaaagactgccggcgaagatcagtacttcagtgtgccgtttgcaaatggcaaggccgtctttgggattggttcttctgctacggttccggtgttgcttcaacaggcacccaagagtcttgattggggtaccgcggtcattccggaatacgaagcaagcgcagcaacccgctcaacgggaattataatgtgcttttcaaaggcgcctctaaagcgcaacaagccggcgcctgggccttccagaagttcttgctgaagtcggaaaatgccgcacagtgggccaaggcttcaggttacgtgccagtgactaagagtgcatctaacagtgccacctttaaagcctatctggaaaagaacacgcaatacaaagcagctgtttcagcagtctcacaaagctttgcctctactgtttttgccggttacaccgactaccgcaacgatttgatgagtaccgttgacagtaccttgaccaagaatgtcagtggcgaaaccgctttgataatctacaaaagcagaccgacaaaattttagaagaaaataaatagttttttaatcagccagtaataccgcgatgtgttactggctttttgctgccatgtcggtaaacaaccgtctgtcgctgccgatgtcatgatgcggacatggcgcaaaacagtttacatcattgaggtcggatttgcgccgtattaccttagtgggctatgatggtcaaagcgttgttatgcattaaaggagaccgatatggaaatcaatgtacacaaatttcaggaagctattttggccggcactttcgaacacacagcagttcacgtcactgctgcggcattcaagaaagacggcatcgctgacgcactgacgaaggtctttgcagatgtccgcgcggcgattgagaaggatcaattgattcaggcggatttggtggttgatttccctgaaccgacaaccattaccgttgagaccgggatcatcancctgccatttgcgaatgttaataaaatccctaattttctggaaccggatgaaattgttccggtacgggtttatttaattgtggcatcaccttttgtcaacgtatcaggtttgcgcattgatgaagccgcgactgccgctgattatttgcaggattttgacacgatc

SEQ ID NO: 126 - DNA, 698 bp, Lactobacillus rhamnosus
  misc_feature (1)...(698): n = A,T,C or G
accccacccgggtggaaaatcgatgggcccgcggccgctctagaagtactctcgagaagctttttgaattctttggatcaattcggcggtngtttgcgcccgcggcatcggactggcgtaaataccggcaaaaccggtcgtagcaaaataccgcccaactgcctccgcgccagcccggccagccggagtcagcggcgtatccgtccgcccgccattgaaccgccgcgccaaattggtctccgtctgcccatggcgcacaaaataaaacttggtcatccttccacacactccttttaaaaccagtgtagcagaagattcagtgaaagcgttcaccagcacgtaaaaattcagactagcttaatcaagtttaaaaattaagctttaacgacgccattttaacggcggacgccaagctgtacgacaaaaagccgatcacacaagttgcatgtgtcggctttttgctgcaagtattcattttatagacagcccgtgaaacgtagctagcttgcgggctaaccttattctgctgccgtacctgctggtgtcttatggtcttcttgtgcttcagccttgtatgctgcaacctcgtcatcagccgcaaaaatatagtgatcaggatagacttcgaccattttgcgctgcttgttatcaccttcgactttgcttgcatcgtaagggatcggaactcgtttgcgctc

SEQ ID NO: 127 - DNA, 436 bp, Lactobacillus rhamnosus
tacacttacctggtaccccacccgggtggaaaatcgatgggcccgcggccgctctagaagtactctcgagaagctttttgaattctttggatcggcgtcaggtacggcaaccgttggatatgcgcggtacggtctggcttttggttgcgttgttagcactgatgtacggattccagacgcttgctgaacccaatgcgatttggcagttagcggggatggcacttattgccgttgttggcttttggcgtttttggcaggcagagcggcgggcagttgatcaaggctattttaacgaattggggaccggcgtttggattcaagaactttgccaaaatgacaatcgtggccaattccaccaaccaagggcttacgaacattatcggtatcaaaacacttgatacgagcattgtcggagcattagtagtggccggtattg

SEQ ID NO: 128 - DNA, 1044 bp, Lactobacillus rhamnosus
  misc_feature (1)...(1044): n = A,T,C or G
gaaggtatggcgcgtcagccagaaatgaccgggaccntgcgtggnacgatgttcatcggtgaattctttggatcgaagctgttccgattatttctgttgttattgccttcatgttgatgcttcgttaattttgagtcatcaataaagaagggagtggcaaaagatgagtttaggtgacacactcttcacactcgtcacatttttggtcctgatgatcgcggtcgggaaagttgcttggaagcccgtctcaaagatgatggcggagcgccaacaaaaaatttccggcgacttggattatgctgaaaagtcccgcaaagatgccgaggcattagcggctaagcgtcgagaagcgctgcaacacgcccaagccgatgctgttaagattgtcaatcaagctaaagaaaatggtgaaaagcaacgccaatcattggttgacgctgctaacaccgaagtcgctacgttaaagaaaaatgcgcaagctgacattgaccaagcgcgcaaagacgcactggccagtgccaaaaatgatgtggcagatttaagtttaaccattgcccagaagctgattggcaaggagcttaatgcagacgatcaaaaagacttgatcgacgactatatcaaacggttaggtgatgcaaatggcagtcactaatcaaatggttgcaccgcgttatgctaaagcgttgttagaagcggcgcatgaccaaaatcaggtggagacggttcatgaagagttacaggcgttagcgtctgtattcaaagaaaatccaacaatcctgacaatttttgacaatgcccgaatttcagccgcagacaaagccaacttgttgacaactttgaccaaggatgcaagcccacttgttgctaacttgttaaagttgacccaacagtatggccgattcggtgcattaccggcaattatcacgacgtttaatcgcgcctatgatgatgaagccggcattattgcagcaactgtgacgactgcagttgctttgtcagccgaccaagccgatgctttacgcagttctattgctgcgcgttttg

SEQ ID NO: 129 - DNA, 2031 bp, Lactobacillus rhamnosus
  misc_feature (1)...(2031): n = A,T,C or G
aattcatccatgtggctttttctttcccgggaaaaaagtaaaaggccagtcacatggatgagaaaatccagtggctggccttttttggcgagtgagttctgtagtgcgagtgccagtgcaattagaaggtggctcgcgctcaccataacgcgttcacagggccagaaacctgcgtgtaaggacccttggtcgcaatggccaagagcgggccatcacgcccaaggccgcttacactccggtttctaagcggccctgttcacgctcactttattttaggaggaagcagagaatgatgattaaaaaaatggctgccgttgtagcagcagcgttgacggttgtggctttggctggttgtggtaaatccacgagtgctgcggctgataagagtcaggtgaaggttggggttttgcaattgattgatcagcaagccttaaccgcagcacgaaaaggttttaccgaagagcttgctaaagccggttacaagggtaagaagatcaaacttgattatgtcaatgcccaaggcgatcagtcgaatttgcagacgatgagccaacgcctgaagcgggataagaacgatgttaacctagcgattgccactccggcagctcaggctttgcataaggaagatgctacaacgccaatgctgtttacagcggtgacggatccgtattgtggattaaccactcatctgcataatacttggcaatgtagtaatcgtgcaattgtgcaggccantgtgccggatcctcagcatcaagtgcactaagcatgatgaagcggccgacatccttggcttcggcggctttcatggttttgatggccccatctaagtcaaccccgagtaaatcttttccccgcgatcctgcagcgaacacaactgcatcatgaccggcgaaaaggtctgctaatcgattgaccggccatgacagatcaagctcgactgcgcgaaagtttttctccggatcgggtgtctgggtgagcgggtcacgatagcctcctgtgaccgtatcgcctcgatccagtaatttatgcaccaatagctggccgatttgaccgtgggcgccgacaacaaaaattttcacaacaatgatcctttcttggaaaatgattgttattagtataacgttttttgtgctgacgtgaaagcgctcgccgctgactgaacacagcagtgagtggggtgaggcgttgttttgactaaatgatttccagaggaacgtgatgacgaggcatcgggaaggcttgatcaaatagatctaattcgtccggtgaaaatgtgacgtctgctgcggcaatgttttctgccatgtggctagcttcaccagtgcgggggatagacagcacgtcaccattgcgcaatacccaagcaagcaggagctggtgagtcgaaatgcccttgctttttgccaagtcggtgagttccggagttagcttgatggatttgccgctgccggaaccataaggcgagtaaccaatcgtggtgatccctgcctgcttctggcgtggaagtaagtcaaagtcaataccgcgtgattgtaggttatacaagacttcattggcaacgacttgctcgccacccggttccaaagtgagctgatccatatcgtcaacatcgaagtttgagaccccgtattggcgaatcagtccctcttttttcagctcttgtaagccttcaagggtttccgccagtggggtagccccgcgccagtgaagtaggtaaagatcgagataatcggttttaagtcgcgacaagctatttgtcagcgccgttcgcatttgctttttgtcggcatgtgacggatagaatttagagatcagatagatattggcccgtgggtnatcgcctaaaaagctgccgatcaaggtttccgccgcgccgttgccatacatttcggctgtatcaatcacccgcaagccgtgatctaacccgtactttaaagcttgggtttcgcgtgcgctttgttcagcgttgccttcacctaaataccaggtgcccattccgacaattggaactgttacatcgccaatatt

SEQ ID NO: 130 - DNA, 1725 bp, Lactobacillus rhamnosus
gatcataatacccgctgatttgtttgataattcttccggttaattcttcactcattgtgtaatattgtactcctgtgcgacaacggtgccatctcgtaccacccgataactacccggatacgtcttgttgacttgcaaggtaatggtgacctgattatccgcggtaatattaaacgtcttgttaaccgaattaatgttatgtgtcttatcgccgatgaacacctgaaccccgtttggcgtcggtccactgctgctagcactgccactactgcttccgctgtcgctggatgtgcttgaagatgccggcgcctgataagggattgaaatggttttggtaacggttttgagttcatcgggatccggaccttgagaaatcgtcacattgaccgtatcgcctgcgtgaacctgcgtgccagcagccggattctggctaattaccataccggtatcaacggtgtcggaatgactctgagcaatcacaatcttaagtccgacctcatttgcgtagtcacgcagactcttttccgtataaccggtaagatcccgcagtgcaaaggccgtattgactttcttaatcggctctgcaacatcaaacgtaatcgtggttttacttgcaatgacttttttgccgggtttaatgctttgtgccgtgatttttccggctgcgaccgaatttgttcggaccactttttccttgacggtaacaccgcgtttttgcaaatcggattttgcatccgtataatcctgaccgacataattatccaaggtaatgcgcggctgtccgcgactcagtatcagatcaaccgccgagccttctttgacactgacctgccgcttaggactagagtctataaccagatccctatcgactttggttgagtaagtatagcgatactttccgaccttcaatcgcgaactggttagtgccgttttagcttgcgtcttggtcatcccgcgcaaatcagggaccgtcacatcggctttttgattggccgtcaccaatccaattcctaccagtattaacatcacgatcaaggcgctcaggccgatcatcaaccatcgccgtcgtttcttcttagcctggccatctggtgaatggtgttcagcaggttggtctgcgtgatcgtcatcatcatgcggtggcttggggccgttgggaatgaccggtacaatgcgcgtctcatccaaatcatcttttggaatcacatacttggcttcgtgagcccgggctgcaggaattcgatatcaagcttatcgataccgtcgacctcgagcagatgatgcgtgacgggaccatcaccgacgcacagacgttggccgcgtggaccctgatgttgctcgacggacggtgagctgcgttcgccacgaacgtcattcgacggtccgggccgatatcaacccgtgacgcaaccgtgcccgaaccgaccgtgtcggtccggcaccttgacgggtagggaaattaagtttgctgtgccagccctagaaactgtgaggaaaccatgccggtgcgacgtgcgcgcagtgcgcttgcgtccgtgaccttcgtcgcggccgcgtgcgtgggcgctgagggcaccgcactggcggcgacgccggactggagcgggcgctacacggtggtgacgttcgcctccgacaaactcggcacgagtgtggccgcccgccagccagaaccgacttcagcggtcagtacaccttcagcacgtcctgtgtgggcacctgcgt

SEQ ID NO: 131 - DNA, 2435 bp, Lactobacillus rhamnosus
  misc_feature (1)...(2435): n = A,T,C or G
gatcagttaactactactatctttttcactaagacacataaaaaccagcccagatttctctgaactggctctaaagtttggcaggattttggcagggaaccaagtaaattctactcatttcaacccgtttcacttcgtctgaaatgccgttaaatcaagcttttcacttcaagtgatacctgcattttattcccaatcaattgatgcagctgatattcgtaacgtagctttgctcaatccagatcgcagcaagtttgaatttgaatccattgcttccaccgatatcgtttctgcaccttatgactttttggaagccgataccccgacgattctggtttcgtttgctcggagcgggaactcaccggaaagcctgaagaccgttgagctcgcggaacaagttgtgcataaccttcatcagatcagcattacctgtgctcctgaaggccaattggcaaagaagtccgctactgaagataagaccttgttgctgttgcagccagcaggttctaacgataaaggctttgccatgaccggcagtttctcatgcatgacgttgagtgctttgctcgtctttgacactgccagtgatgatgacaagcgtcaatgggttcaggcgatcgccgcgatggggaaagaagtcgtagcgcgtgaagctgaaattcaagcggtattggatcaagactttgaacggatcgtctatctgggttccggcagtctcggcgggttgacgcgtgaaactcggttgaaggtacttgaactcaccgcgggccaatacgcaacgatgtttgacacctccatgggcttccgtcacggaccaaagagcttcgttaacgacaagacactgttgttcgacttggttagcaacaatgcttatacccgccaatatgacatcgacgtgcttgaagaagtcaaagacgacaagattgccccttctgtcatggcagtcggaaccaagcaggatcagaacttctcaggtgacggtttctactttgaaaatggcctcaaggatcttccggaaggctaccaagcattgcctgatgttatgtttgcccagactgtggcacttttggcttccatcaaggttggcaacttacctgataccccatcaccgaccggcaccgttaatcgcgtggtaaaaggagttatcctccacgactattcaggtcaggaataaggttgcaactgtcatggcgccatttagtcgagcaagtcggttagatggcgttgctaaaactgggaggcaagtgttcatgagttattacattcacgccgcaaaattctttctcaaacatgtgactgaaattggcgggtatctagaagtgaccgatgatggccagtttggtcaatatttacctgaaagtgccaaaccagaaggcgagattgtggaacagccaggcaagctaattgcgcccgggttggttgacacccacattcatggccttttgggacacgatgtcatggataacgattgggacggcatcaataccatgagccagaatctgctcaaggcaggcgttacaagctggctacccaccactttgaccgggtccttcgatcagctaaacgatgtctgcaaaaccatcgcggctcatgcaggcgaagaatccggcgccaagattcaaggcatttattttgaaggcccatacttcacaaccaaacacaaaggcgcacaaaacccgaagtatttcaaaaatccgagtgaaaaggaatacgatgcgtggcaaacttcggccaatggcttattgaaaaaaatcgccattgcgccagaacgtgacggcgcagttgcgtttacgcggtatgcgaccggagacggaaccgttgtggcgctgggtcatagtgatgccacctttgaacaggcaaaagcttgtgtcgaagcgggtgccactgttttcacgcatacctttaacgggatgagcccactgagtcatcgggcacccggaatggtgggcgctgcaatgtacctacaaggcgttgatgacgagctgatttgtgatggtcatcatgtgcggcccgaagttgcgaccacgttaattcggctaaaaggcgcagagcacattgctttgatcaccgattgcatgcgcgccggaatgatgcctgatggtgattatgtactgggtgaattcccggtttacgtcaaagacggcatggcgcggttaaaagatggcgacagtttggccggttcggtgttggaactaaaagatgccttgacgaatctcttagcttggaacgcagccacgccagaagccattatccgcatggcaacccaaactccggctgcttcctgcaagattgacgatcaatgtgggagcattttaccgggtcgagctgctgactatctggttttggatgctgacttgaagctgcaggtnctttattcagataaacaaaccgctactgagctccagtcacagctacgccaagcattcgccagtcct

SEQ ID NO: 132 - DNA, 3099 bp, Lactobacillus rhamnosus
  misc_feature (1)...(3099): n = A,T,C or G
cgggccccccctcgaggtcgacggtatcgataagctttgatttgacgagcataggttcaagtttccacttgagaaacaaacaaagaaaaggacaaatgaattttttgcgagccaagcgctatcaagggttcgttcatttgtccttctttttttgcctaaaaacaggttgcgcattagccacttagtcggaacgatcctcaagcttcttcacgccgagagtagttggtgggagactgcctgcgagggtaggaagctgccacgctgtttattccggtttagctcagttggtagagcacctgactgttaatcaggttgtcgtcagttcgagcctgacaaccggagttttttatggagagttgtccgagaggctgaaggagcatggttggaaaccatgtatacgggttttgcctgtatcaagggttcgaatcccttactctccgtttttatgcttctagatgctttctatagcttcccggaatgctggtataaaggcattccgggatttttgtttccttttattttcggttgtttttttcctccggtgcacaaaatgtgcacaagctaaagtctcgaaagtgcttgtagcgtctgggatacctgctcttttctttgatcttcaagaagatgagcgtagactttttgagtgatcattgtattggcatgcccaagtcttcttgaaatatagttaatgtcaacgtgattggcaatcaaataggaaacgtgagtgtgtctaagcccatggaaagtaatcgcgggggaaatgtcgagagtcttctcgatcgtccttagatccttattaattgccgtgctcgatagcatgttatgccgtatgctacgaaataatagttgtttgctatcacgatatccctgagcaaggtagacctcttgctgttctttcttgagacgtaaaagcaagtctgcaagttctctcgtgatgtcgatgtcacgtacacttgatttgttcttagtagcagcaaagccgctgccatatctgtgatcccacgttctggtaatgtgcacaacgcgctttttaagatcaacatgatcccacgttagcccaagaacttcagaatacctagctccggtcagtgccccggttgcgatgatgtagtaagcaatatgctcgtagtctgcaaattctaggcagtaattgacgagcttgcgcaaatcctttacttgcaaatatttgatgattcctgcttggccttcattaccagtgaggacaacgttatgagtgaagttagtatatattatttggtcatcgacggcagaatcagccattgagcgaacatagccattcaatttgctgactgtatctttagccctttttttgccaaactcattgataaatccctgccagtctgattttgaaattgattttagttcacggctttcgccccaataggctaataactgtttacgaattgttttataccgggcttcggtgatacgagaatgcttaccagatttgtacagctcaatccatttgtcccagtagtcgattaacgttatcttgttaagatccaaatttgcaccgcgattatgctgacgttcgacttcgattgccgctatatcagcagctttttttgaggggaagccacccttgttgacatacttgcgtgttccatcattatccttgtaagagacacgatattgccattttttgccacgtttactaatgctggccatcattcatacctccttgtgctacaatacaaacaggtgctattgcacccaccacacagtcattgatccataaggcgtctacccgttcactttggtcggtggggtaggcgctttttattttgtatccagccccactctccggcttgcacggggacgccgcttgcgtggggaaagggactaatcaccatagtcgtcgggagcggttccggcgtcatcaatcttcttggccaaagccaatggaactgtgattttgccacccatggtagatttgtaagtggtggtacccaagctttcagcatagaangtgatcttgtcattttctagaatgcgagagccgttcataatatctggatcataaccgaccataattacattgtcataattaccatcaactgcaacacgcaaatcagtttcatcgtcaccctcaacaacttgaataacttcgcctgttaaagtgatgttcttgcccttgtagtcgtctggagtccgtgccaactgttcataagtgatcccagtgttgtagtcagctgcgttgaatgtttctgtgcttgatgattcttcatcatcagagtcatcgctatcagtgtcttcgtaactgtcatcatcatcttgtgacgactcgacctttgacgattcagcttttgaagacgaactagacgcagctgacctcttgctttctcccgagtaggtaccaatccaaaaaaagattgcaataaatgctaccgccgacaatgcggtaataataaggttccgctttagttttctcggatcctttctttgaactatagacaatgtgccaaatattgcagccaataggagcgatcctaaaaaggcaattaagataagtagtttcattattcccctccaaaaaattcagcttttaacgtcgatcagagtttggacgtgagattttatagaactaccgtgtacacgactaccttgccaatgatgntgatgttctcttcttcaaggtcttcgtatgtgtacatgatggggctaaatcttttgtcagttgaatccggaatgaaggtaacaatctgcttttgacgatcattatagaaatatttgactgcgtagtcaccatcatctgcaaatacaacaatgtcgccgtctttaaggtcttgaatgtcgttgtactgtttgactgctattaaagaaccatcaggaattgtttggttcattgattcgccattaacatgcatcattaatatgctactgtctccggcatatcttcccataacactatctggcagttgaatcgtttcaacgtcatcggaagttagcggatcgacattgcacaagattccagccgatatatcagcgggaatgtatggataagagtgaacatttagttttttgactttaaaaggatctacaggagaaactcctattaggctttccggagtgtgtgta

SEQ ID NO: 133 - DNA, 729 bp, Lactobacillus rhamnosus
gatcgcgattttaaagtgaattgactgaaagaagcgaatctttttattcaacagtggtgctcctaattattcagcgtcaggatttcgcaaataatagcctacgccgcgtcgggtcaccaaccactcaggatgggacggattgtcttcgatcttctcgcggaggcggcgaaccgtcacatccacagtccggacatcgccaaagtagtcatagccccaaactgtctgtagcagatgttcgcgggtcataacctgtcccaagtggcgggcaaggtaatgcagcaattcaaactcgcggtgggttaattcgatattctcaccgcgtttagataccgtatacgcgtccggatgaatcgttaaatcgccaacttccaattcacgattggcttcgtcttcctcactgccggcagcattggctgatgaggtacggcgcaagttagccttcacccgcgcaacaagttctcgattggaaaacggcttggtaacataatcatctgccccaagctccagtcctaacactttatcaatttcggaatccttcgccgtcagcataataatcggcgtgtcatgttctttacgaatttgtcgggcaacttcaagcccatcaattttcggtaacatcaaatcaagtaaaatcaaatcaggtgattctgattcaactttcttcaaggcttcttcgccatcatatgcagtgacgacatcatagccttctttatccaaattaaacttgac

SEQ ID NO: 134 - DNA, 360 bp, Lactobacillus rhamnosus
cacgtcagttaccgatgttgctgacactggcggatgagtcccatgtgctatatggcagtgatattccgtacacagctccgatgatcgccgcacaaatgttgaaactgtttgagcctgagacataccgcgccaaaatggcaaaccgaatcaccaaattgaaacactttgatccggttatgacgcattttaaaaagttccgtgcactaccaaccgtgctgaacatgtcgagtaaaatgttgaccggtgcggaaattttgtcaccggaaatggcgcaggatattttggtcaataacgggcaacggctgctcggtaaaatttgaccggattaaagcgtaaaacgccttatgcggtggcgggatc

SEQ ID NO: 135 - DNA, 3286 bp, Lactobacillus rhamnosus
  misc_feature (1)...(3286): n = A,T,C or G
cattcgctttatcgcgatggataaggtcacgcgacaaatcatcggtgatacgaacaaactgcgcggtgattacgtgaccctgaccatttattttcgcttgtttatcgcggatatgtttccacagtatgacaaagcgattatattgatgccgacacggtagcagaagatgacttgaccactttgtttgcancggatttaagtgataacctggttgctggtgtggccgatccggtgatgatgacttatccggaaaccatgacttacattcaacgcgatttcggcattcagccaggtaagtatattaattccggtgttttgttgatgaatctcgcgcagatgcgtcaggagcatttttccgatcggttcttgcacttgttgaagacttaccattttacgatgattgctgctgaccaggattatatcaatgtcatcgcacaacatcgcatcaaatatttaccgaagctctggaatatgcaaaccggggtccctgcggctgcagagactggtggaaagttgattcactataatttgtttggcaagccttggcattatcatcatgctaaattaggcgatcgcttttggcggtatgcaccggattcgggatttgaagcggaactgaagcagcagttggcggcatttacgttggcggatcagcaggctgatcggcaaagtatgagtgggatgttgcagacggctattgctgtttgccacacggagaatacaattttgaatgccgttaaacatggcgagcaggtggcgctatgaaatcgggccggtttgtcggtccggatcgcgcggcagttgttggcaatattcggcgtgcggtggcggctaaagcgtttaatattaaagtcgaagaacatgatccggtgttttccaagtcggaagagcaacggattgtgacacattacttacaacagcgccaggacaagctgtttaagctcaagacactggtttgtcgcttggtcgttaatgcctatgcgttacaggtgaccaaagatgttgaagtagtcggggtcgataaaattcggggcatcaaaagtggcggtgtgattacaagcaatcatttcagcccatttgaaaatatggctgtgcgtaaagccgtgcatctggcaggacggcaccgcatgtatattgtcagtcaggatacaaacttggcaatgaaagggctgctaggctttgtgatgaactatgatgatacgattccgctgtccggacgccccagtttcttaaatggtccgtttaaacaaatgttgaatgcggcgtttgcgggtcatcactgggtgttaatctatcctgaacaggaaatgtggttcaattatcgtaaaccacgaccacctaagcgcggcgcttatttctatgctgccgaggcgggcgttccgattatctcctgttttacggaaattcgtgatctgccagtccgcgagaatcagcaactgcgcgaagttcgttatattttgcatgttcttgatccaatttatccggatccgaagctttcggcgcgcgacaatagtttttacatgatgcagcgtgattatgccaaaaatgtcaagcgtatacggccgcttatggcaaaccgttatcctatgcttttacgcagcaggatattgctngtggatcctaaacggcaagccacagaatagactaaccaaaggcgaacttttctttcgatgggaagttcgtttttattttgtcatttggcgctatctgcttaatgggtcgaaccaagcattagcgaaaaacggtacttatgtgacaccgatgctgacggcagaatgccacttatagaaaggtacatcaaaacagtttatatgctataacaaaggtgatgtttatcgcggaaaggggaccctaattgatcgatgttactgacgatcatgcttttcatttatataatcaaaagatcagctatatttgtgcgttattgccaaatggtcagttgggccatctctattttggccccagattatcgttaacgactgctgatttgacctatctatcgcaaggttccagtccgtttgcgtggatggctaacttttccgacgatcagccgtttgcattaggtgatgcgcaacaagagtatccggtttatggaactggcgattttcggcaaggcagtttaagtgtgacccaagcagacgcacccgtgtatccgaattttgtgtttaaagattatcaggtgagtcacaccaagatgcgggatttgcatcatccaacgagctttggtaatccagccttgactnatgttttgacaattcaccttgaagatgaaacggcgcagttattattaacgctgcagtatacgattttttcggatagtgccacggttgttcggcagctactttgacgaaccaaggtgctgagccggttatgattgagcggatgttgagcggggcgctgaatttaccccaaggccgttatgatgttgttcacttgtcaggtaactgggccaaagagcggcacattcagacacagcctttgacgcaaggaacgttttcagtggaatctttgcgcggggcatcgagtcatgaacaaaatccgttcgtcgcattgcacgcagccggacaaccatttgctgttggcgatgcttacggtgcgaacttagtctattcggggaattttctggatagcattgaagttaatgaatgggatcagacgcgacttttggctggcattcatccggcttcttttagctggcgactggatccgaaaaccagctttactacccctgaagtggtcttaagctttagttcagcgggactagctggtttatcccaggccaatcagcgttttgtggcccggcatattattgacccgcaatggcgtcaaaagccgcgtccggttgttttgaacagttgggaagcgacctattttgacttgaatgaacaaaagttgctgcatctggctaaattgggacgtcagttgggggttgactgttttgttcttgatgatggctggtttggtacccgcgacaatgatttaagttcgttgggggattggttcacaaataagcataagtttccggatggcttggggcattttgctgaggaaattcatagccttggccttcagtttggcctgtggtttgaaccggaaatggtatcgcctcgatcgcaatttttccaggaacatccggattgggtggtccgtcccaagcgcggccgaatgtcgattacacgtcatcaatatgttctggactttagtaatccaacggtcgtaaataatatttttgcgcaaatgcaacgcgtcattaccgaaaccaagcttgattatgtsaagtgggatc

SEQ ID NO: 136 - DNA, 3999 bp, Lactobacillus rhamnosus
  misc_feature (1)...(3999): n = A,T,C or G
cattcgctttatcgcgatggataaggtcacgcgacaaatcatcggtgatacgaacaaactgcgcggtgattacgtgaccctgaccatttattttcgcttgtttatcgcggatatgtttccacagtatgacaaagcgattatattgatgccgacacggtagcagaagatgacttgaccactttgtttgcancggatttaagtgataacctggttgctggtgtggccgatccggtgatgatgacttatccggaaaccatgacttacattcaacgcgatttcggcattcagccaggtaagtatattaattccggtgttttgttgatgaatctcgcgcagatgcgtcaggagcatttttccgatcggttcttgcacttgttgaagacttaccattttacgatgattgctgctgaccaggattatatcaatgtcatcgcacaacatcgcatcaaatatttaccgaagctctggaatatgcaaaccggggtccctgcggctgcagagactggtggaaagttgattcactataatttgtttggcaagccttggcattatcatcatgctaaattaggcgatcgcttttggcggtatgcaccggattcgggatttgaagcggaactgaagcagcagttggcggcatttacgttggcggatcagcaggctgatcggcaaagtatgagtgggatgttgcagacggctattgctgtttgccacacggagaatacaattttgaatgccgttaaacatggcgagcaggtggcgctatgaaatcgggccggtttgtcggtccggatcgcgcggcagttgttggcaatattcggcgtgcggtggcggctaaagcgtttaatattaaagtcgaagaacatgatccggtgttttccaagtcggaagagcaacggattgtgacacattacttacaacagcgccaggacaagctgtttaagctcaagacactggtttgtcgcttggtcgttaatgcctatgcgttacaggtgaccaaagatgttgaagtagtcggggtcgataaaattcggggcatcaaaagtggcggtgtgattacaagcaatcatttcagcccatttgaaaatatggctgtgcgtaaagccgtgcatctggcaggacggcaccgcatgtatattgtcagtcaggatacaaacttggcaatgaaagggctgctaggctttgtgatgaactatgatgatacgattccgctgtccggacgccccagtttcttaaatggtccgtttaaacaaatgttgaatgcggcgtttgcgggtcatcactgggtgttaatctatcctgaacaggaaatgtggttcaattatcgtaaaccacgaccacctaagcgcggcgcttatttctatgctgccgaggcgggcgttccgattatctcctgttttacggaaattcgtgatctgccagtccgcgagaatcagcaactgcgcgaagttcgttatattttgcatgttcttgatccaatttatccggatccgaagctttcggcgcgcgacaatagtttttacatgatgcagcgtgattatgccaaaaatgtcaagcgtatacggccgcttatggcaaaccgttatcctatgcttttacgcagcaggatattgctngtggatcctaaacggcaagccacagaatagactaaccaaaggcgaacttttctttcgatgggaagttcgtttttattttgtcatttggcgctatctgcttaatgggtcgaaccaagcattagcgaaaaacggtacttatgtgacaccgatgctgacggcagaatgccacttatagaaaggtacatcaaaacagtttatatgctataacaaaggtgatgtttatcgcggaaaggggaccctaattgatcgatgttactgacgatcatgcttttcatttatataatcaaaagatcagctatatttgtgcgttattgccaaatggtcagttgggccatctctattttggccccagattatcgttaacgactgctgatttgacctatctatcgcaaggttccagtccgtttgcgtggatggctaacttttccgacgatcagccgtttgcattaggtgatgcgcaacaagagtatccggtttatggaactggcgattttcggcaaggcagtttaagtgtgacccaagcagacgcacccgtgtatccgaattttgtgtttaaagattatcaggtgagtcacaccaagatgcgggatttgcatcatccaacgagctttggtaatccagccttgactnatgttttgacaattcaccttgaagatgaaacggcgcagttattattaacgctgcagtatacgattttttcggatagtgccacggttgttcggcagctactttgacgaaccaaggtgctgagccggttatgattgagcggatgttgagcggggcgctgaatttaccccaaggccgttatgatgttgttcacttgtcaggtaactgggccaaagagcggcacattcagacacagcctttgacgcaaggaacgttttcagtggaatctttgcgcggggcatcgagtcatgaacaaaatccgttcgtcgcattgcacgcagccggacaaccatttgctgttggcgatgcttacggtgcgaacttagtctattcggggaattttctggatagcattgaagttaatgaatgggatcagacgcgacttttggctggcattcatccggcttcttttagctggcgactggatccgaaaaccagctttactacccctgaagtggtcttaagctttagttcagcgggactagctggtttatcccaggccaatcagcgttttgtggcccggcatattattgacccgcaatggcgtcaaaagccgcgtccggttgttttgaacagttgggaagcgacctattttgacttgaatgaacaaaagttgctgcatctggctaaattgggacgtcagttgggggttgactgttttgttcttgatgatggctggtttggtacccgcgacaatgatttaagttcgttgggggattggttcacaaataagcataagtttccggatggcttggggcattttgctgaggaaattcatagccttggccttcagtttggcctgtggtttgaaccggaaatggtatcgcctcgatcgcaatttttccaggaacatccggattgggtggtccgtcccaagcgcggccgaatgtcgattacacgtcatcaatatgttctggactttagtaatccaacggtcgtaaataatatttttgcgcaaatgcaacgcgtcattaccgaaaccaagcttgattatgtgaagtgggatcttaatcgcagtattaccgaagcctattcaccctacctggcaaaaattgggcatcctcaaggtgaattcntccatcgctatgtacaaggtgtctataccctctatcaaaagctgctcacggcctttcntcacntgctnattgaagnctgtgctggtggtgncgggcgctttgatttggggattctcttttatagtccgcaaatctggaccagtgatgattctgatgcgatcgacggttgcaattcaatcaggaaccgcactggcttatccgttaagttgtatgagcaatcacgtgacggcgataccgaatgaacaagtcggacgctccacaccgttggctacgcgatttagtgtggcagcgtttggtattctcggctatgaattggatttgaccaaactggatgaggcggcattggcagcaatcaaaaaccaaattgcttattatcatgaattacaaccattagtcttaaatggtgattttcggctgcttttgccacgtcaatccaacagccagaatcaagtcgcatggctgctaagcgatcattcccgcaagcgtttagtcttaggcttcttccgcgtccttgccgatgcagacagtcgcgccgtgcagtatatgaagataccggttgcccagccaaaccaacgttattgggtaaacggtcacactgggccggtttccggtgatgtcttgcagcgggttggcgttcgcttacc

SEQ ID NO: 137 - DNA, 2221 bp, Lactobacillus rhamnosus
  misc_feature (1)...(2221): n = A,T,C or G
gtagcgccttgtgcttgccaataagcgtaaagtgtcgtttctaagtcacgcgtgagttgggttttcatgatgggcctnccaaaagtgtgtcagtaattgtgctaattgcgtgggattgtagctaacctgggcgtgggtccagtgatcaggaaacagacgggcataacgcggggtgataaagcgttcatcaatgagcaggattacgccgacatctttggccccgcgaatcacccggccacctgcctgcaagacattgttaaagcctggcagctggtacgcgtaggcaaagccctgaccagcatcgtgatcaaaatatgctcgcaactgatcggtttccggattgatgcccggtaagcccactgacacaatcgccaccccaatcaattgcgtccctttgaggtcaatcccttcagcaaaaatgccgccaagcacagcaaaaccaatcaccggctcactgccagccttaaagtgatcaagaaatgcttgccgctcactttcattcatggcattttcctgaacacaggttttaagatcaatcatgaaatcgttaagttcttgttggtgcgcggcaaaatcaagtccgttcgtttgatcggaaatctgaagtttcatgattttcagattctggccggtaataaaaacttcaatggtactttgccgactgcgcgcaccccgcatggtcagacgctggtgatcacgatgcatgacgaaaccgatacgctggcggtgaatctcaagtacaccatcgttggtgatctgcctgtcctgcttaaacaagtggcttaccataatctgagtgacgataccctcacgatcacccatgcagccagcttacaactggattttgatgatcacgcttacgatctcattactttgacgggcgcccatctcagcgaagccagcgtcacccggcaaccgctcacaccgggtaaaaagtccatcgccagcaattatggtgccagtggtccacaaggggttccggcaacgattctggcggcaccggcaactgatgactttgcaggcgaggcgcttggtatggcgctgttgtggagtggtaattttagctacaccgcgcaagtcgatcagtttggcaacagtcggctggtgatgggcctgaatccggagctcttttcctggcagctgaagcctggtgaaccgtttgtgaccccggaagcggcggtggcttacacgaccaatggcttgaatgatctcagtcatattttccaccgcttttttgccgatcacgtcatgccattgccgcggaagaatctgatcgaatataacacttgggagtctacgtactttgatgtcagtgaagccaaggtgcgcgcggagattcctaaggccgaggcgctcggggtggaattgattgtgattgatgatggctggttcaaaaatcggccgaatgatgccggccagctcggcgattgggtgcctgatccggtcaagtttccacgcgggttgcgcccgattgctgatgccttgcacgaacgcggactagcatttggcttgtgggtcgaaccggaaatgatcactgaaaatagtgagttatatgccaaacatccagactgggcgatgcaatatgttggccaaaagccgttacgttcgcggaatcagttaattttggatcttagccagcgaattgttcaggatcatctgattaaggtgctaaccgatttggtccggaccaatcatattgattatttaaaatgggattacaaccgccacttcagccaacccggaagtccggtgctgccacctgatcaacaaggtgaagtcggctatcgttacacccgcggcttgtatcgggttttgaaaacgttgcgcaacactttccccgatctgcttatcgaaaattgctcgtcaggcggtggccggttggatggcgggatgctggcgtatacggatcaaacctggaccagcgatttcaccgatcccgtttaccggatgaaaattatgaacggcttctccttattcttcccgcttaaaaccttcgtctcgcatttcacgatgtcaccaaatttgcaggactcgcgagtgacgcctttgcaaacgcgggcgctgctcagtctggtgggcgttaccgggattgagtgtccgccaagccagttgagtgacgctgaagccgcggcggttaaagccagctttgccttttacaaagctaatcgcacggaattgcaaaatggcagtctttatcggctgcatcccagtcatccgaatc

SEQ ID NO: 138 - DNA, 845 bp, Lactobacillus rhamnosus
  misc_feature (1)...(845): n = A,T,C or G
acgcttacgatctcattactttgacgggcgcccatctcagcgaagccagcgtcacccggcaaccgctcacaccgggtaaaaagtccatcgccagcaattatggtgccagtggtccacaaggggttccggcaacgattctggcggcaccggcaactgatgactttgcaggcgaggcgcttggtatggcgctgttgtggagtggtaattttagctacaccgcgcaagtcgatcagtttggcaacagtcggctggtgatgggcctgaatccggagctcttttcctggcagctgaagcctggtgaaccgtttgtgaccccggaagcggcggtggcttacacgaccaatggcttgaatgatctcagtcatattttccaccgcttttttgccgatcacgtnatgccattgccgcggaagaatctgatcgaatataacacttgggagtctacgtactttgatgtcagtgaagccaaggtgcgcgcggagattcctaaggccgaggcgctcggggtggaattgattgtgattgatgatggctggttcaaaaatcggccgaatgatgccggccagctcggcgattgggtgcctgatccggtcaagtttccacgcgggttgcgcccgattgctgatgccttgcacgaacgcggactagcatttggcttgtgggtcgaaccggaaatgatcactgaaaatagtgagttatatgccaaacatccagactgggcgatgcaatatgttggccaaaagccgttacgttcgcggaatcagttaattttggatcttagccagcgaatgttcagatcatctgattaagtgctaaccgatttgtcggaccaatcatatgattat

SEQ ID NO: 139 - DNA, 1217 bp, Lactobacillus rhamnosus
  misc_feature (1)...(1217): n = A,T,C or G
gatctgcttatcgaaaattgctcgtcaggcggtggccggttggatggcgggatgctggcgtatacggatcaacctggaccagcgatttcaccgatcccgtttaccggatgaaaattatgaacggcttctccttatncttcccgcttaaaaccttcgtctcgcatttcacgatgtcaccaaatttgcaggactcgcgagtgacgcctttgcaaacgcgggcgctgctcagtctggtgggcgttaccgggattgagtgtccgccaagccagttgagtgacgctgaagccgcggcggttaaagccagctttgccttttacaaagctaatcgcacggaattgcaaaatggcagtctttatcggctgcatcccagtcatccgaatcaggatcaggtgtgctggctgatcaccaacgaagccaaaaccaaggcgcttgtcttaacgtcggctggcgtggtttcgccgattccgcactaccaacatgtgctgttgcattacctcaacccggaagtatcctaccagattaatgacaaggccacggccaccggtgctgaactcaattatgccgggatcactttaccgctggcgcatggtgatttttccgctaccttaatgaccctgcgcgtggtgagtcacctgccacaaaccacggcactgcctggtggcgacatcggtgagttgcgattttagtgaagtcagcaaaagtttcttaagtagtttatcttatatagaaagtttggtttccacatgaagtttatcatcgcaccggctaagaaaatggtggtcgctcaggacgatttccctgttcaaagtcagccgcagtttcgcgatcaggcggcgtggctgttgcgtcacatgcagcagctcacccgcgcagaagcccaaacactgtggcataccagcgaaaaactcaccggcgcggcctacgaacagctgcaaaccagtgatgtggcggcgcaccaatcacctgcgattttcagctatgtcgggattcagtatcagtacatggcgcctgacctgttggatgatgccggcttancgtacattcagcaacatttacgaattttatctggtctatacggtattttgcgaccgtttgacggcattgttccatatcggttggaaatgcaaacccgtctggctgcggtgccgaatcatagcttatataatttttggggcgatcagctgtatcaggcactggcgaccatccccggcccgatc

SEQ ID NO: 140 - DNA, 490 bp, Lactobacillus rhamnosus
  misc_feature (1)...(490): n = A,T,C or G
accgcgccggctcgcgctcagctcacaggaggacagactaccatggcaaacatagaatacgacccgcaaaaacagcttttccacntgcataatgatacgtttagctatatcattcaggtgattcgcggctatttggtcaagcggtattgcggaccggcgcttgaacgtttttccggtactgccaagctggaagatttcagtcatgcgtttaacattcaaaatgatgcggcgccgttttcgctcacgaccctgccgcttgaatatagtacgctgatgggcggggattatcggacgcctgcctatgctgtgcgcaatgggcatggacaattgatcacccgaagcctgagtaagttgaatacgcttgaagccattgcgttttaataaataggcacaaaattcctcaaacttctcaccttccatgatgtccacgctctccatcttcaaatctcgaaaccgaaaatgatgatggtacagcaacaacgcattgatc

SEQ ID NO: 141 - DNA, 1691 bp, Lactobacillus rhamnosus
gtcacgttctttttcattaaccagatgtaaagcgtcatcgccaaggcgcccatgatcatgacggtgaagaagccataggaaccgaagaacttaccaaagttgaaaaagccccacatgctcacgttcttgccatcgactaccccaccggcatcggtgattaacttggcagcacctttactcagcgtgccttttagcggcagcatgaagttttgcggcaggctcataataaacgtgcctaacaccacaatgcccccggttaccggttcaacttggtattgaactgccagctggtagccaaacgtaaaggcgaatagcagccctaaaattgccagtgtgccggtccaaaccatggcgttgataccgatcagccactgcatggaatcgactatccccatccacttaaattgggtcggaatatcgcgaatcaaaacgttcaagacagtggaaaccgccccagccatcatcgccggcatgatcgcaataaacgcgtcacgcaacgccactaaccaacgaatggagccgatcttggctgcaaccggcacaacatgtcgattcaaccatcctataaatgcattcatatcactgtactcccttcagaattttaaataatgtcgcattaatacttaactacaattaaaattctacgggagtgcagatcggcgggtcaaagattatagtagttattatttataatttttataagcaagaagtttgactttgccggtttggttaagcgctttcttaggaagtgtcctgatgcagcttcggagagatattacaaccgcacatgtggatgccacacattgaaaaatcagttgaaatatttatagcagcaaagtaattggtcgccttgttcgcatattagtatagaaagcaagagctggcggagcggtggcgggctcagtggtgaaattggtcttaagcggagtgggccttctccgctttagaccaaggccgagcttcgaaaccgcggtctttgcgggttcgaagtcgtgcccaccactctagctgcgcggtcgccagccctcgccaacgcggagccagctcggagtataggaaatcacttaattagagtagaaccgagaaaaagttgacacttacccgcaatctcccctaccgagcaaatatgacctcttttgcttataatagattaaagttagaatttttcagcgcaaccacacgccataacgcgctccccggcgcagaagcctgcacataaggaccttgggcgcaatggctaaaacccgccatcacgcccaaggccacttatgcttcggcttctaaccgcgccggctcgcgctcagctcacaggaggacagactaccatggcaaacatagaatacgacccgcaaaaacagcttttccacctgcataatgatacgtttagctatatcattcaggtgattcgcggctatttggtcaagcggtattgcggaccggcgcttgaacgtttttccggtactgccaagctggaagatttcagtcatgcgtttaacattcaaaatgatgcggcgccgttttcgctcacgaccctgccgcttgaatatagtacgctgatgggcggggattatcggacgcctgcctatgctgtgcgcaatgggcatggacaattgatcgtaggggtgatttttttgtgagcgtaagccagcccgcttagaagctgtttgaggtctctattgacgagcaagcag

SEQ ID NO: 142 - DNA, 673 bp, Lactobacillus rhamnosus
cagctcggagtataggaaatcacttaattagagtagaaccgagaaaaagttgacacttacccgcaatctcccctaccgagcaaatatgacctcttttgcttataatagattaaagttagaatttttcagcgcaaccacacgccataacgcgctccccggcgcagaagcctgcacataaggaccttgggcgcaatggctaaaacccgccatcacgcccaaggccacttatgcttcggcttctaaccgcgccggctcgcgctcagctcacaggaggacagactaccatggcaaacatagaatacgacccgcaaaaacagcttttccacctgcataatgatacgtttagctatatcattcaggtgattcgcggctatttggtcaagcggtattgcggaccggcgcttgaacgtttttccggtactgccaagctggaagatttcagtcatgcgtttaacattcaaaatgatgcggcgccgttttcgctcacgaccctgccgcttgaatatagtacgctgatgggcggggattatcggacgcctgcctatgctgtgcgcaatgggcatggacaattgatcggaaatctgaagtttcatgattttcagattctggccggtaataaaaacttcaatggtactttgccgactgcgcgcaccccgcatggtcagacgctggt

SEQ ID NO: 143 - DNA, 604 bp, Lactobacillus rhamnosus
cgcaaaaacagcttttccacctgcataatgatacgtttagctatatcattcaggtgattcgcggctatttggtcaagcggtattgcggaccggcgcttgaacgtttttccggtactgccaagctggaagatttcagtcatgcgtttaacattcaaaatgatgcggcgccgttttcgctcacgaccctgccgcttgaatatagtacgctgatgggcggggattatcggacgcctgcctatgctgtgcgcaatgggcatggacaattgatcgcaaaatgctggccgaagatggcattttcattgcggttgtcaccattgaccgtaagaaaaagcgcgttgtttccaagcccaaagtcacaagtcgcgggtttgtttatcttaaaaccagtcgtgacttattggccgaaagcggcaccttggtaacggagacggtacaaaagaatctggataacaaagaatttgactggacccatttgaaacaagatgttcgagataaactcagccgcttcttattcgaacagacaaagcggcgtcctgtcattttgccggtcatcatggaaattaatcaaaacagtgcaaaacggcaataaacaacaaaaaattcg

SEQ ID NO: 144 - DNA, 1848 bp, Lactobacillus rhamnosus
tgtgcgactcaaatacaggcagattcaaaggaggaagcaccatgacttatatttttcagattttaccggcattattatctggtgtgaaaatgacgttggggatttttgccatcactttagtcggagccattccactgggtctcattttatcagtcggcttaattcccaagcctaaatcgctacttggtaaggcaggaaaaagcttgctggaaggctatgtgtgggtatttcggggcacgccgctgttgttgcagctgatgtttatcttttacggcctgccgattatcggtatcgtgtttgaccgcttctcagctgctttagtcgcgtttattttgaattatgctgcttacttcgcagaaatcttccgtggtggctttggcgcaattgatgaaggtcagttcgaagcaagtacggtcctcaacatgacccgctggcaggcactgcggtttgtggtcattcctcaggttgtcaagattgtgctaccttccatcggtaatgaagtcatcaacttggttaaggattctagcctggtttacgtcattggcttaggcgatttgcttcgagcaggtaacatcgctagtgcgcgggatgttaccttgctgccactggtattggtcggggtcatctacttactgctgacgctgattctgacgttcctacaaaaacggatcgaagcagcattttcatattatcgctaggagggttaaaaatgttagaactcaagaatatcagcaaagcgtttaacgggcggccggttttaaaagatgttaacgtcacgattgaagatggcaaaacattggcgattgtgggtcccagtggtgccggtaaaaccaccttattgcggatcatcagtggtttggaaaatgctgatggcggcaccatgatctggaacggtcagcccacgaccgcccaggctttacgcaaacaaggcgttatcggcgttgtgtttcagaactttgagctattcccgaatttatcggttctacgcaatattaccttggcgcctaccttacagggtgttgatcagctttccgtccatacccgtcaagaagtctatcaaagtcgcggtcaactcaaaacggtcttggccaaacttgacccgcaagcatttatccaagtaacgaaaagcagtcttttgaatattaattatttaacgtcactagaagcgtctttttccgggaacatgacagccttcatggcgaataacatgaagttaactgtcagtcgtaaatatcttcctgcgttaaaacgcttgttaggattgtgaggtgcccgatgaaaatcatcaaagatcttatcacggatagcgttatcggtatgatgatcggtgcgactgtttatctaggtgcgctcatgctacacgtccaactgaccccaccaacgccacgcaccatcgctggcttgtttgtgatgagcgctttaatcgggatgctcgcccttatttttgacaatgaatccctcagcctgcctgtagcctatagccttcattttatcggcaccttcgccattgtcatcggtaccaactatctcatgggctggcaatttctcgtcggatcggcactcccaaattttctaatcgcctttttgatcatttacgtcctcatctggctggcgctttatctttcctggcaggtcacagctagaaagatgaaccacgtgttaaaaaaacgtcaaggaaaatagtcttatcctagctaagtgtcgaaatattcccgacactttttttgctcccactgctactatcgacacatcaggctgaaaaataaaccaatccgatttttaatcagtatgtccgtttgcgcaccgtctaggcgatccaaacgcgttcacctgtccagaaaccggact

SEQ ID NO: 145 - DNA, 942 bp, Lactobacillus rhamnosus
gatccagcttaacatggacggctggggtgccaatcccaaaacgccattctcgtttgatcagcaaacaacggcgatcaatcgtgcttacaacaagcaaaagaccatgctgatgccttacaactacacggcgtctgcgcaaagtgtctttgatggtaagccaatggtgcgcggtctgttccttgattatccgaacattcctgaggcatataccgatctggtcaagtacgaatacctctggggcgataacttccttgttgcgccgatttaccaaaacacggcggctgatgaaaagggaaacgatgtacgtaacggcatttacctccctgacaagcagcaagtttggatcgattattacaccggcaaggaatatcgtggcggtcaggtcttaaacaacttcgaagcgccgatttggaagttgccggttttcgttaaaaaaggcgccgtgattccaaccacgcccgcacacaatacgcccaaagcatttgaccaaaccaagcggcagtttcagattttcccggcgagtggcaaaaacgattttacggtttacgaagatgacggcatttcgaaaaagtatctaaaaggtgcgcatgcccaaaccaaggttaccagcgaattgcaaaaggatcagttgaccgtgaacgttgatcctctgacaggtgattacagcggcttaaatccagatcgagccactgaatttgccattcgaacgagcggcaagccggctaaagttacggccagtgttggcggacaaacggttaaactgaccgccgtcgataacctcaaagactttactgcaggcgaaaatgtttattttgttaataaacaatatcatacgaatgatttcttggatctttgtagttgccacaactcttgatgtcaacaccgggtacatcatcccaggtaatatcgttagcaatcgcttcaaggctggacttcagcgct

SEQ ID NO: 146 - DNA, 1231 bp, Lactobacillus rhamnosus
tcgatgcgaaaccctatgacttattgaaagattattacgacttgacgggtgcaccggcgatgatgccgcgttatggcctgtatgaagcacacttgaatgcctataaccgtgacacttgggttccggtacctgaaggaacaagcggtgcgattaagtttgaagacggcaaatattataaagaatatcagcctgggaaaattcctgctggccaaagtggtatcaaagaatcgttgaacggggagctgaataattatcaatttagtgctcgcgccgttattgatcggtatcagaaaaatgatatgccgctgggatggtttttgccaaacgatggttatggtgcaggctatgggcagaccgatactttagcaggcaacttgcaaaatcttaagtcgtttgcggattatgcggatcagcatggcgttgcaaccgggctgtggacgcaacaaaacttgtcgccagttgatccggccaatccgaaaccggatgatcgtgattttgccaaggaagttgccattggtgtcaaggccctgaaaactgacgtggcctgggtcgggtccgggtattcttttggcttagatggtctggctaaagctgatgcgatgatgacgcaggtcaaaggcgattcgttgcggccgtttgcgattacgcttgatggctgggccgggacgcagcggtatgccggcgtgtggacgggtgatcaaaccggtggccagtgggaatacattcgctttcatattccaacgtatatcgggaccggtttatccggacagccgtatgtaggttccgatatggacggaatttttggcggcggtaatccgatcgtcaacacccgcgattttcagtggaaagccttcacgccgatccagcttaacatggacggctggggtgccaatcccaaaacgccattctcgtttgatcagcaaacaacggcgatcaatcgtgcttacaacaagcaaaagaccatgctgatgccttacaactacacggcgtctgcgcaaagtgtctttgatggtaagccaatggtgcgcggtctgttccttgattatccgaacattcctgaggcatataccgatctggtcaagtacgaatacctctggggcgataacttccttgttgcgccgatttaccaaaacacggcggctgatgaaaagggaaacgatgtacgtaacggcatttaccttcctgacaagcagcaagtttggatcgattattacaccggcaaggaatatcg

SEQ ID NO: 147 - DNA, 544 bp, Lactobacillus rhamnosus
tgggttatgacgaccagccgtttgcaccgtttgcccgcgtgccgctgacgaccgtccatcagcctattgccgaaatggcgcaggtggcaacggacttactattagccggacttgaccgcggtgaaccggctgtggctccagaaccgttaactttgacgttaaaaatcaggcaaagcgcctgaattttatttttggtaaatatggaatcgataccacattttgaaaaaggagttccgcatgcttaacgaaaccagccgcacatggtggcaacaagaaattttctatcaaatttatccggcgtcctttaaagatagcaacaatgacggcattggcgatttgccagggattaccagcgagttgccgaagctcaaggccttaggagtgacggcaatttggttgtcgccggtttatcgaagcccgatggtggataatggctatgacatctccgactatcaggcaattgacccgcgctttggcaccatggctgattttgacgcgttgatggccgctgctaaagaactagggattaaagtggtgatggatc

SEQ ID NO: 148 - DNA, 933 bp, Lactobacillus rhamnosus
  misc_feature (1)...(933): n = A,T,C or G
aattcactttattggaataaccacgatcaaccaagagtcgtatcccgatttggcgatgataccaccgaagaaaaccgcgtcctcagcgctaaaatgcttgcgaccatgctgcacatgcaacaaggaaccccatatatctatgagggtgaagaaataggcatgaccaatgcatacttctccaaaattgaagactatgttgatattgatcacttaactcttatcaccaaatcgttgaagagcaacatcttgtcgacaaaacaccatgatgaattacatcaagatgcatagccgcgataatgcgcggacgccgatgcaatggagtgatcacgaaaatgcaggcttttcgaaacacagtccttgggaaaaaatgaacccaaactttaaaactattaatgttcaacaagcattgggtgatccaaattcagtgttttattattatcaaaagctcatcaagctacgtcatacactcccagtcatcaccgacggcacctacgcattaatcgccggaaattctgacgatgaggagatttatgctttcacaagaacaancgctgataccacacttgtcgtcattctaaactacacgaacaaaaacttgactcgccattatgatcttccaagtcacgcgaaaatattaatttctaattacgctgatgatcaaggagacaacattcggccatatgaagcaaaagtttatcaatactaagagaaaggtatagctaatatgtctaaaaatacgatgaatccttcagtagatagcaaggaaaaagtcgaaacgaccacagtcgatagcagtatgcctgacctgtccatgcagacgatcttgagttgagggctgcgcaaaaagacaacctgaccgatgtgtgccaactcttgggccgttttgggttgaggttggcgccagatgccatgcttaaccggtagcgacggatc

SEQ ID NO: 149 - DNA, 1096 bp, Lactobacillus rhamnosus
  misc_feature (1)...(1096): n = A,T,C or G
ccagtcatcaccgacggcacctacgcattaatccccggaaattctgacgatgaggagatttatgctttcacaagaacaaacgctgataccacacttgtcgtcattctaaactacacgaacaaaaacttgactcgccattatgatcttccaagtcacgcgaaaatattaatttctaattacgctgatgatcaaggagacaacattcggccatatgaagcaaaagtttatcaatactaagagaaaggtatagctaatatgtctaaaaatacgatgaatccttcagtagatagcaaggaaaaagtcgaaacgaccacagtcgatagcagtatgcctgacctgtccatgcagacgatcttagccatgacgtttgggtgcattggggtcaacatggcgtttacgctacaaggatctcaaatgagtcgaatcacccaaacgattggcgttaatcctaatagtctcggcttcttctttctactaccacccttgttaggcatggttgttcagccactactaggtaaatattctgacaagacctggacccgctttggccgccggatcccgtatttgttgtttggtgcgccaattgctgccattgtgatggttatgcttccctttactggctcatttggttttggctatggctcaatcactgcgcttgtatacgctgctgtcgcaattgctctcatggacttgttcagcaatgtttgcctagctccatatcgaatgatggccggcgacatggtcaataacaagcaaaagaatctggcatggtcttggcaacagatcttcagttacgctggcggtatcttggctgcattgctgccctaccttctgacgatgggtggcatgtcaaatactgccgctaaaggtcaggtacctaatacagttatttgggcttacttaatcggcgcagccatccttcttttgaccactttngtanccgtactcaaggtcaaggagatgatnntgaaacgtatgccaaatatcatgaaattgacctcaaaaagcaacacgctaaaaccccaagtctctggcaacttacaaaaacagcgccaaagtctttctgggaactggctgttgttcaattattcagctg

SEQ ID NO: 150 - DNA, 795 bp, Lactobacillus rhamnosus
tgcgcgggtgcccgtttatctatcaaggtcaggagttgggaatggtgaatgcggttcgcagcagcattgatcaatttaacgatttgtcggcgcatgataattatcggcgggcgcttgcagaagggtactcggaggcggacgccttggcatgtgtcaatcgtcgctcgcgtgataatgctcgcacgccgtatccatgggacgacgaggcaaacggcgggttcagtgatcaccagccgtggctaccggtggcccagcaagcgcccggcgtcaactggcaggatgaacagatcgatcccgattcggtctggcacttttaccaaaagctgtgccagttgcgcaatgattcgccgtttcggtcggatcggcgttgccaaaaacggaatgaaaaacatcggattcataataatcggcatcccgaaaagtaccggttcgttaactgagaatgttcccgggataaaaagccgctttcccgactgcttttaattgtgccgaacgcgccgcaaacagcatcacgaacgcgacaaccagagtcgatcccgtaccgccaaaattcataacataatccatcgtgttcatcgccaacacatgtgaaacatgctgtccggcttgatattgctggagattggccgctgtattggcaatcatgatcggaacaacagccggctggacaattgaaggcccctgaaccccacagaaccagaagaatgccatcgcgccggcaatcaacgctaaccccagataagaatcactggcctggaagagtggcgacaacacttgaataatccagcgcggcag

SEQ ID NO: 151 - DNA, 377 bp, Lactobacillus rhamnosus
  misc_feature (1)...(377): n = A,T,C or G
ggaaattctgacgatgaggagatttatgctttcacaagaacaaacgctgataccacacttgtcgtcattctaaactacacgaacaaaaacttgactcgccattatgatcttccaagtcacgcgaaaatattaatttctaattacgctgatgatcaaggagacaacattcggccatatgaagcaaaagtttatcaatactaagagaaaggtatagctaatatgtctaaaaatacgatgaatccttcagtagatagcaaggaaaaagtcgaaacgaccacagtcgatagcagtatgcctgacctgtccatgcagacgatcttagccatgacgtttgggtgcattggggtccaacaanggcgttcacgccngcnaggatc

SEQ ID NO: 152 - DNA, 449 bp, Lactobacillus rhamnosus
cgatgcaatggagtgatcacgaaaatgcaggcttttcgaaacacagtccttgggaaaaaatgaacccaaactttaaaactattaatgttcaacaagcattgggtgatccaaattcagtgttttattattatcaaaagctcatcaagctacgtcatacactcccagtcatcaccgacggcacctacgcattaatccccggaaattctgacgatgaggagatttatgctttcacaagaacaaacgctgataccacacttgtcgtcattctaaactacacgaacaaaaacttgactcgccattatgatcttccaagtcacgcgaaaatattaatttctaattacgctgatgatcgcaacaccaggtgcgttgacccctttcttgccaccaagaacaccgtcattttgaacaacggtgacaagttcgcggttctctcatctttttcggtgatc

SEQ ID NO: 153 - DNA, 2958 bp, Lactobacillus rhamnosus
  misc_feature (1)...(2958): n = A,T,C or G
gatatcgaattcagttgttaaagaatatgtttcatctagatgacgttatttcaactaatatgcacgcattaacacgtgcacgggcgcttaaattagaaacaatataccggctgtttttgttcgattcaagatcgctggaacgggcagctggagcaatgagtgatgggcagttttctgcaatagagattttaccgagtggctatgctctgtcggaatacgacaagatcagaaaatatgcgggggatacgaaattaattgcaggagggtttatacggtcagaaaagaatatttccgacatttttgctgcaggattttggggcgttacgacaagcgatcgtcaactttggcagtatggggtgaatcgtagttaaatatctacccatacatgagggggatagacaagtatgtcaaaaaaatatttgatgggtatcgataatggtggaacgagtacaaaagctgccatttatgatatggatggtcatgagctagaaaagactactgttaatacaaaaatgttgactccgcatccgttctttacagagcgtgatatgaacgaactttggaaagctaatatctatgttataaaacaaacactcgaaaagtcgcacattgatcctagaaatatatcgggaatagcatgtactggacatggaaacggcctgtatctggttgatgataaaggaaatgctgttcgtaatggcattatttctaccgatgatcgggccgccgcttatgtgaaaaagtggctagcggatccttactatgaaaacgagattcgtcccaagacttatcaaacggtttggtcttcacagccagtcgcgcttttggcctggttgcaagataacgaacctgaagtatttgaacgaaccaaatacatcttcatgattccggacctcattcggttttggttaacgggcgatgcacattttgagattactaatgcatctggaacaagcatgttaaatatcaatacgaaaaagtttgatcaggatttgttcaagttctttgggattgaacgatggatggctaagctgccaccgctagcaaactctaccgatcattgcggtagtatatcaagaaaaatcgcaagtgaaacaggtcttgtcgagggaactccgtgttcgggtggggtattcgatattgcggcttccgcgttgtcaacaggattggtgcaccgtcacaaacttggaattgtaaccggaacttggtcaatcaacgagtacattacgaacaagcctaaagttgtcaaagacttatttatgacttcaatttatccgatagcagatcgttggttgattacggaagccagtcccacatcagctagtaacttagaatggttcatcaatactttcatggataaggagaagagggctgcagaggatgcaggattttcaatatacgagtattgcaacaagcttgttgcaagcacaaaaccacaggatagtgatttactatttttcccctttatctttggtggtaatgcggtaccgaatgctagtgctggttttgtgggagctacaaaatatcacgatcttaaatattttgttcgtgcagtttatgagggcgttgtcttttcgcatatgtatcacattgaaaagttacgaagaattgatgggcatttagacggtgctgctcgtattgctggcgggatcaccaactctcaagtttggttgcagatttttgcaaatgtcttaaagcagcctttagaacttgntaacgtgaaagaaaatggaactcttgggactgctatgacagcgggggtcatgacaggagactttaagancgttgaggatgcngcaaaccacatggtgcatattagccgaacaattcttcctcaacccgagtttgaagatgtttatcaaaagaaatatgaatgttataagaaagcattgacaaacatggaacctgtttggaatggactacaganngtnngaattatctcgtatgaagatatggaggttttaataatggatttaggtattaaagggaagaacgccattattacaggaggagcaactggactggtcacaatttgttctcggattagcaaaagaaggcgctaatgttgcttttacgtacatgagtgaaaaagaaaagccagagcagacggttgaaaaggtgcatgcaattaatccaagtttgaaagcggtgcctgttttaacaaatctggccgacgaaacacagattgttaatttcttcgatacagcacttcaaaagcttggcagcgttgatattgtcgtgaacaatgcgggtatttggctttcaggaaaagtggtggacattcctgctaaagattgggacttgacgatgaaagtcaaccttcgagctccgttcttactatgccagcaatttgttcgatatgctctgaagacgaagcggagaggtcatattgtcaatgtgacatcacaagcggcttattatggatcaacaactggacatgctcactatgcggcaagtaaagctggattaattgctttttcaatttcattagctcgtgaagtcgcaaaaaatggaattaatatcaataatatcgcagtcggagtgatgcatacgcgaatgattcaagccaatcttgataaagatcctaattactatgtaaaccgtattccaatgggacgtgtcgcggaaccatccgaaatcgcagagctaggaatctttcttgcatctgagccagccagttatatgactggggcaactgttgatgttaccggtggtatgttaatgcattaataaatggggagatagataaaatgaaggcaatcgcatttggtgataatttaattgatgtttccatgttaaaagctggtcttactactctggaaaatgcggggattgatgtgacaatccgagattggtctcacgaatccactgctgcacttcaagcagacaatctgaaggttgagcagcatggcccggaagcagtaaacgttgacgattcgcttttgaaagatattgatc

SEQ ID NO: 154 - DNA, 435 bp, Lactobacillus rhamnosus
  misc_feature (1)...(435): n = A,T,C or G
cgcggtttggaacgatggctgattttgaagagttggcgcagaaacttaaagctgctgggatcgacatcatgttggacatggtgctcaatcataccagcacacaacatgtctggttccaaaaagccttagctggcgacaagcactatcaggattattactacattcgaccaccaaagccggatggcagcttgccgactaactgggagagcaagtttggcggtccggcttgggccccgtttggcgacactggcaattattatttacatttatacgaacgtcgccaagctgatctcgattggcataatccagccgtccgtcagaagcagccgctattattaatttttggcgcgccaaangggttcacggtttccgctttgatgtgctcaacgtcattggcaaggccaatcagctggttgatgcgccaccggaagtcga

SEQ ID NO: 155 - DNA, 372 bp, Lactobacillus rhamnosus
ggtgaagccgacatgtattacctgcacgtcttttccccgcagcagccggacttgaactgggagaatcccaagctgcggcaggcaatttaccagatgattaactggtggctgcaaaaggcttgcgggcttccgggtcgatgcgatcactttcatcaaaaaggatcaggattttgcagcgattacgccagatggcagcgatggtctgggaaaggtgaagcggaaggcagagaatcggcccggcctggcacgcttccttaaagaactgaacgctgctacctttaagcctgccaatgccgtgacaatcggtgaggcttccggggtcgcctatgatgaactaggcgatttcatcggtccaaacggctacttttccat

SEQ ID NO: 156 - DNA, 657 bp, Lactobacillus rhamnosus
atggtgttcccgacaatgcgtaaatgtgatcgcgccagtaaccgaatttcggtttgcgcgaaacatattgatcaccgacattaaaaccgccaatatagccaacgtgatctggtcaagtacgaatacctctggggcgataacttccttgttgcgccgatttaccaaaacacggcggctgatgaaaagggaaacgatgtacgtaacggcatttacctccctgacaagcagcaagtttggatcgattattacaccggcaaggaatatcgtggcggtcaggtcttaaacaacttcgaagcgccgatttggaagttgccggttttcgttaaaaaaggcgccgtgattccaaccacgcccgcacacaatacgcccaaagcatttgaccaaaccaagcggcagtttcagattttcccggcgagtggcaaaaacgattttacggtttacgaagatgacggcatttcgaaaaagtatctaaaaggtgcgcatgcccaaaccaaggttaccagcgaattgcaaaaggatctattaactcgtacagaaaaagtctccgcaattggagactttttcttcggcatcaataaatacgctacatcaaagtggatacaccacatgaaaagactcaagtacaatccgcgccgtttccgggtcaaactgcttccc

SEQ ID NO: 157 - DNA, 1608 bp, Lactobacillus rhamnosus
  misc_feature (1)...(1608): n = A,T,C or G
tagggtttaacacggtggaaacctatgtgccgtggaacttgcatgagtatcgtgaaggcgagtttgattttagcggcatcctcgatattgagcgttttctcaaaactgccgaagaactcggcttgtatgcgattgtgcggccgtctccttatatctgtgcagagtgggagtttggcggatttccggcatggctgttgacgaagaagatgcgtctgcgtaccgatgatccaacttatttggcggcaattgatcgttactataccgcattgatgccgcatttagttgatcatcaagttacccacggcggcaatgtgatcatgatgcaggtggaaaacgagtacggttcttatggtgaggatcaggattacttggcggtggttgcgaaactgatgcagcaacacggagttgatgtgccactgttcacttcagatggaccgtggccagccaccttaaacgccgggagtatgattgatgccggcattctggcaacgggcaacttcggctcggctgccgataagaatttcgatcggttagccgcttttcatcaggaacacggtcgcgactggccattgatgtgcatggaattctgggatggctggtttaaccgctggggtgagccgattatccgccgcgatccggatgaaaccgcggaagatctgcgcgccgtcattaagcgcggcagtgtgaatctctacatgtttcacgggggtacaaactttggcttcatgaacgggacgtctgcgcgtaaagaccatgacctgcctcaggtaacgtcttacgattacgatgccccgctaaatgaacaaggtaatccaacgccaaagtactttgccattcaaaaaatgatccatgaagagcttccagaagttcagcaagccaagccgctggttaaacccacgatggcgccagcttcacacccgttaacggctaaagtttccttgttcgcagtcttggatcagttagccaaaccgatcgccgcttcttatccgcagacgcaagaatttctgggccaatataccggctataccttgtatcgtacgcagccgctcattagtggcactgacaaaggaacaccggccaagttgcgggtgatcgatgcccgtgatcgggtgcaagcttatttggatcaaaaatggctagcaacccaataccaagaagcaattggtgatgatatcttgttgccggaagttgagggacatcatcaacttgatttactggtagaaaacatgagtcgggtgaattacggatccannantgaggcgatcacncagttcaaagggattcgcaccggtgtcatggttgatctgcacttcatcaagggctatcagcaatacccgctagacttgaatcgcgcttctcggcttacctttacggaaggctggcagcccgcgaccccagcgttttacaagtacacgtttggtttgaccgccccgcaagatacctatcttgattgtcgtggattcggtaaaggagtgatgctggttaatggtgtaaatgtcggcaggttttgggagaaaggccccacgttgtcactttatgtaccggcaggactcctgcacgccgggaaaaatgacgtcattgtgtttgaaacgaaggccgctacgccga

SEQ ID NO: 158 - DNA, 1015 bp, Lactobacillus rhamnosus
  misc_feature (1)...(1015): n = A,T,C or G
gatcacattgccgccgtgggtaacttgatgatcaactaaatgcggcatcaatgcggtatagtaacgatcaattgccgccaaataagttggatcatcggtacgcagacgcatcttcttcgtcaacagccatgccggaaatccgccaaactcccactctgcacagatataaggagacggccgcacaatcgcatacaagccgagttcttcggcagttttgagaaaacgctcaatatcgaggatgccgctaaaatcaaactcgccttcacgatactcatgcaagttccacggcacataggtttccaccgtgttaaaccctaaagctttaaggttatacaggctgtgataccagtcactcggatgcacccgaaaataatgaatggcaccagataggatcttgaacggcttcccatccaacataaattcatgatcgatcgaaaaggtcgtcacgaactttaacctcccttcaaagtgtgagcgtgatccggcgcgctcagaagtcggagtgtaagtggccatagacgtgatggccgggctttggccattgcggctaaggtccttacacgcagacttctgcgccggtgaacgcgttatgatgagcgtgaaccggcgtgcttatggcaatccacaacgattnataacacccgttctgctgccataatccagtgtcacacattaacgccatttttcacaaggttttgtgtcangaaagctgtcatgcttctgcttgatacgcaagttttccatcgagataggttgcctgcagcttcaagtcagcatccaaaaccagatagtcagcagctcgacccggtaaaatgctcccacattgatccttgattggttgccgattgagccgttctcgtttgagtaggttgaagaagctttccattggtgcgttatcatggcaattacctttacgagacatgctgggaacgatgcccatggcgtgcacctgagactggtattcacgggtttggtattgccacccttggtcagagtgcatgatgggtgtgacgcc

SEQ ID NO: 159 - DNA, 294 bp, Lactobacillus rhamnosus
  misc_feature (1)...(294): n = A,T,C or G
cgggtgcatccgagtgactggtatcacagcctgtatanccttaaagctttagggtttaacacggtggaaacctatgtgccgtggaacttgcatgagtatcgtgaaggcgagtttgattttagcggcatcctcgatattgagcgttttctcaaaactgccgaagaactcggcttgtatgcgattgtgcggccgtctccttatatctactcataaggcaccccaggctttacactttatgcttccggctcgaagaagatgcgtangcgtgangatgatccaacttatttggcggca

SEQ ID NO: 160 - DNA, 2455 bp, Lactobacillus rhamnosus
  misc_feature (1)...(2455): n = A,T,C or G
agcgcacggatcagaaactggatggactttggcaatttaagtttgatgaagctggagaaggtgaaaaatccggctgggagaccggttttcacgatggcgtttcgatgccggttccggctagtttcaatgacttctttacggataaagcaagtcgtgaatataccggtgatttctggtacagtcgcaacttttttgtcccttctgcggctaagggaaaggcattgtttctgcggtttgatgcggtaactcaccgggccacgatttttgttaatggcaaagagattcgaacgcatgaaggcggctttttaccatttgcggccgatatcagcgaggccgttaagtatggtgccgaaaataccgtggttgtcaaaggtaataacgaattgtcgcgggaagcattgccggccggggatacgattacgctgcggaatggtaagaaaatggtgcgcccgttctttgacttctataattactccggtttaaatcgctcggttcacttgttgtccttgcctcaagagcggntgtnggattataccactacttttgcgttagctggtaacgatgcancagtgaactatacggttgaaaccaatggcgacgcgccggtaacggttagtctggcagacgcggatggccaagtggttgcgactgctcaaggcaaacaaggtgccttacaggttcaaaacgctcacctatggcaggttcgcaatgcctatctttatacgctgacgattcagcttggcgatgatacccagacaccgcttgatacttacaccgatcggatccttctcaatcgccgcgcggacatctgcaaagaccttcgtcagtgcgtcagcgatgccgtctttcttgaatgccgcagcagtgacgtgaactgctgtgtgttcgaaagtgccggccaaaatagcttcctgaaatttgtgtacattgatttccatatcggtctcctttaatgcataacaacgctttgaccatcatagcccactaaggtaatacggcgcaaatccgacctcaatgatgtaaactgttttgcgccatgtccgcatcatgacatcggcagcgacagacggttgtttaccgacatggcagcaaaaagccagtaacacatcgcggtattactggctgattaaaaaactatttattttcttctaaaattttgtcggtctgcttttgtagattatcaaagcggtttcgccactgacattcttggtcaaggtactgtcaacggtactcatcaaatcgttgcggtagtcggtgtaaccggcaaaaacagtagaggcaaagctttgtgagactgctgaaacagctgctttgtattgcgtgttcttttccagataggctttaaaggtggcactgttagatgcactcttagtcactggcacgtaacctgaagccttggcccactgtgcggcattttccgacttcagcaagaacttctggaaggcccaggcgccggcttgttgcgctttagaggcgcctttgaaaagcacattataattcccgttgagcgggttgctgcgcttgccttcgtattccggaatgaccgcggtaccccaatcaagactcttgggtgcctgttgaagcaacaccggaaccgtagcagaagaaccaatcccaaagacggccttgccatttgcaaacggcacactgaagtactgatcttcgccggcagtctttaacgcgccactcttgcgcaaatcaaggatctgattcaccgcggctaatgtcttcggtgcattcaagttagccttcaacttcggcgtaatcagctgactgccagcaccataagccatcccttccaaggccacatcataactctgatccagctcgatggcattaatatcggtcccttttagcttatcctgatccgccgcaaaatcagcccaggtctttggcatgctgatgttatactgtgacatcaacttcttgttataaaagagtaccgaagtagaaactgaaaatggcagcccatagtacttaccatcgtatttgcccgccgctaaaaagcttgggtaaatatctttcaattgacgattgcttaatttattcgaaccatttaacatttccgaatcaaatggcaacaacaactgattcttcacatagtcaccgatatttgtatagggtgactgggccatggttggcagcgtcttggattttcctgccgccatgatcttttgttgcaaggcgttgtatgaaccctgagaggtcgcaaccaccttgtacttcttttggctattgttgaatttggtaatcaacttattcagcgacttttcataagtcccggtcatccggtgccagtatgtaattttaaccggcgcactggacgaagactttgccgcagaaccttgcttaccacaggcggtcaataacaataaaatcgcgcccataaaccctaacaaacgccagaaacttgtctttttcatcatatgtccctcatttgatgtcgcggcttacc

SEQ ID NO: 161 - DNA, 379 bp, Lactobacillus rhamnosus
  misc_feature (1)...(379): n = A,T,C or G
cagtgaactatacggttgaaaaccaatggcgacgcgccggtaacggttagtctggcagacgcggatggccaagtggttgcgactgctcaaggcaaacaaggtgccttacaggttcaaaacgctcacctatggcaggttcgcaatgcctatctttatacgctgacgattcagcttggcgatgatacccagacaccgcttgatacttacaccgatcggatcggcattcgcacgatcaagatttccggaaccgatattttggtcaacgacaagccgatttatctgaaaggctttggtcggcatgaanattcaccatttgctggccgngcgtttgacttaaatattgaaaagaaagactttgccttgatgaaatggattggcg

SEQ ID NO: 162 - DNA, 649 bp, Lactobacillus rhamnosus
gttgggtggggtagtagtaagaagggggtaaacttccttgctacacttaagagaataatcgctaattgtgacctttttatgacgttctggcataaaattttagaacggacgtttttttcgtcatcagtgcacttttttggccgaatgactagttattaaaaagaagctgtgagatgtcagtttcttgcaataataatcaatcaaaatgataaacactgtcagattaaagggttaatcatttcttttctacaaaattagtgccgttaacaggaaatcgccacaaaaaaacgttatattaagggtggaaatgtttctaatagaaatttgaaaatggggtaatttgatggacaactcagcatcaaacatcaatgttgatcaactgaccactgaagagaaaatgaaattgacttctggtaaggacttctgggcctccgaagcacttcctgatcataagattccgagtatccgaatgagtgatggaccccacggcttacgttaccaagccgctgctgctgaccatttagggattaatgacagtgttccaagcaccagttttccaaccgcgagtgccagtgcagctacttgggatccggaattgattgccaaaatgggggcagcgatcgggcttgaggctcagagtctgggagtt

SEQ ID NO: 163 - DNA, 934 bp, Lactobacillus rhamnosus
  misc_feature (1)...(934): n = A,T,C or G
gatccgggttaccgtacggacaatccatgagtgtttttgcatttcacgcggtgtattgagtcgcgtgaattctcccgggacaaactcatgatgcggtggcaccttttgaccggttaactgttcaaaatcatggacagttggtttgcctgatagtgtggtataccaatcaggaacatttttgaaattggtgacgttggtgccgtttaagtgaacaggcaacgttgccacaatatcagcagcgcttgtgccaattgctaccgacttggcagcggcaggaagcacccaggtctgggtcttttcctgccattctttaaatgcttgcgcgggtaattccaactggactgcgactgtttcaccagctttaataaagactttcttgaaagcctttagcgctttttccggccgtaatggacgcggctgctgttctttgacgtaagcctgaatcacttctgccccgtccatatcccctgtattggtcacatctaattgaaccgtcaccggctgtccatcggttacttcgtcattgacaagccgtacatgcttgatcgcaaaagtggtgtaactaagaccaaaaccaaacggaaaagccaccggtacttttgccttatcgaagtaacgatacccgatataggaactttctacataaggaaccgcgcgcgtgtgtttgtcataaatctcanctgacacaacgtcttgatagcgtttaggataggttcggctaacttgccactggggttgacttgaccagtcagtacccgtgcggttgccgttccaatatgctccccgcctaaatataaattcaagattgcctgtacctgatctaaccatggcatctcaaccggtgctccggcgaccaataaaacaatgacatgcgggttaatcgctgcaattgcctgaagcaagtcattttgtacttctggcagggccatgttct

SEQ ID NO: 164 - DNA, 334 bp, Lactobacillus rhamnosus
ccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacgaaccaccggatccggtggcacttcatgaaatttatttggaggcgtttcgcattgccgttactgaaggccatccagaatccgtcatgtgctcttataacaaagtaaacggtacttatacgagtgacaatcgctatttaatgacaaacgtgctgcgc

SEQ ID NO: 165 - DNA, 663 bp, Lactobacillus rhamnosus
gatccatacttggccggcaagcttggtgcggcctggattcaaggcatgcagaagcaaggaatcgctgcctgtctcaaacattttgctgcaaataatcaggaaaatggtcgcttgtcgtccgattcgatgattgatccggtggcacttcatgaaatttatttggaggcgtttcgcattgccgttactgaaggccatccagaatccgtcatgtgctcttataacaaagtaaacggtacttatacgagtgacaatcgctatttaatgacaaacgtgctgcgcgatcaattcgggtttgatggtgcggtcatcaccgattggggcgcgttgaacgacaaagtggctgcgcttaatgccggaacggatttagaaatgccaggtgatgatcatttatttgacgatgaggcattgaaggcgttgcagtccggtgaattgcagccggccagtttggatcgtgcagcagctaatattatcaaaatggcgcgtaaacatcggcctagcttccatggtacgcgtgaagctttattacaccaaaatgctcagttagcgcaaaaaattgcggaaaatgccattgtgttactaaaaaacgacgaccacatttttgccattgcagaccagtgaatcattaaccggttgttggtgagatggccaagaaaacccgctttc

SEQ ID NO: 166 - DNA, 237 bp, Lactobacillus rhamnosus
gatccaaggattaaaagattggttatacctcttcaactcagggcaggattttcaaagttacaatcggtttggtgcccatgaagtttcacctggcaaatggtcgtttctcgtctgggcgccacatgcccaacagattaaagttgtcggcgattttaacgattggcgcggcagtccgctgacccggcaaggagaaaccggctgttggtacggcgaactcgcagccaagaaaggacagtg

SEQ ID NO: 167 - DNA, 461 bp, Lactobacillus rhamnosus
ggatccggtttatcgccacagtgatatgaatttattgacgttttcatttatgtatatgtataacgaacagttcgttttaccgttttcccacgatgaagtcgttcacgggaagaagagcctgatgcacaagatgcctggcgatcggtacaaccagtttgccaatctacgcaccatgtacgtgtggcaaatgacgttcccggggaaaaagctattattcatgggcagcgaatggggtcaattccttgaatggcgtgactggagcgagcttgagtgggttgatttgaaagacccgatgaatcataaaatgcaaacttttacgaaaacgctgaatcatatctatacaaaccgaccgagtctttggcaacaggatcatgaaccacttggcattaagatcacaatggcggatgaaccggatgtcatgagttacatccgttatggtaagcaaaaagatgacttcacgg

SEQ ID NO: 168 - DNA, 807 bp, Lactobacillus rhamnosus
aagcacaagtgcaaagttttctgatttccagcgcgatgtattggcttgatcattgtcacctcgatggcctgcgcgtggatgcagtttcgaatatgttgtacatggattatgacgccggcaaagaaaatgatcgcaatcggtttggcggccgcgataatcttgagggtattgcctttttgaagcagctgaatacgaaggtgtttgccaagcatccggatgtcttgatgatggcggaggaaagttcagcctatcctaaggtgtcagcgccgattaataccggtggcctggggttcaattacaaatggaacatgggttggatgaacgatacgctgaagttctttgaagaagatccggtttatcgccacagtgatatgaatttattgacgttttcatttatgtatatgtataacgaacagttcgttttaccgttttcccacgatgaagtcgttcacgggaagaagagcctgatgcacaagatgcctggcgatcggtacaaccagtttgccaatctacgcaccatgtacgtgtggcaaatgacgttcccggggaaaaagctattattcatgggcagcgaatggggtcaattccttgaatggcgtgactggagcgagcttgagtgggttgatttgaaagacccgatgaatcataaaatgcaaacttttacgaaaacgctgaatcatatctatacaaaccgaccgagtctttggcaacaggatcatgaaccacttggcattaagatcacaatggcggatgaaccggatgtcatgagttacatccgttatggtaagcaaaaagatgacttcacgg

SEQ ID NO: 169 - DNA, 356 bp, Lactobacillus rhamnosus
httatgaggtgcatttaggttcttttatccgcgacacgcatgccggtccggatggcgggtatatgacctatcaggatgcgattgataagctgattccttatgtcaaggaattaggatatacccatattgagtttttgccgttgatggagcatccgcttgacgcttcatggggctatcagctgatgggttactttgccccgacaagccggtttggcgacccggcagattttctgagattggtggatgccgctcacgtcgccgggctgggcatcatcatggattgggtgccagggcatttcattaagaataccgatatgctcgctcaattcgatggtaccccgacgtttgaatacacc

SEQ ID NO: 170 - DNA, 694 bp, Lactobacillus rhamnosus
  misc_feature (1)...(694): n = A,T,C or G
gatcgcgcgtttttgcgttgtcgaaagcttgtcatcgccgttactgaagacaagggcaaatgagcgcaccttttgattatggttggcttttttctcaattgtcgcggcaatctggctttcttcgcttttgggtagcgataaggcgcctttatcacgaacaatgccggatacgtcgggcatggttaaaagtgccaccaaaatcacgacaagccagaagataagtgaggggatatggcggtcgtgaagctttttcaattaaacacccttctttcacttgtgaggccattccagacttgatttttcaagtccgcggctaatggtttctgattcgagacatgaccttcaagttgctgttgggcccagacgatgtcgatcatgctgacaatgctgccgtacaaaatcgccagctgcgtccgaacgtcggctttgacaatcacgccgcgctcctggccttccagcaacatgttattgatgagtgtaatcacccggccacgcgcagcacgactctcagcgttaagtgcctcgttgaaaacattttgttgaataaaatgcaactctgtcggatattgctccatggacgcggcagcatcgaataagcggctgaaagtggtctccggatcatccggttggcagtttgccgcggttgccagggagtcgtggaagnagttcataatatcggtaaaggcggtattga

SEQ ID NO: 171 - DNA, 922 bp, Lactobacillus rhamnosus
gacactagtggatcgctagcctggcttgcaaaagcgctggcagacgtagcaaagcttgaagttaagctagctgcctgtcctactttaactgccaaactagcaagagaagcattatcagggaatgaagatgcaaaaccggtagccgcaacattggctgagcttgcagtcgtgctagctgttttggctattgcactagcattatttgcttcagccgaagccgacgttgctgctgtataagctaggctggcgtttttactgtcagctgcagtgctgccggtagtcgtgcctaaacttgcggagagtttggctgcttcacttgctgccgaggtgacaattttggcattttcactagctgcaagtgctgatgctaatgcattggatgctgcagcgttttgctggttttattaccggcaacatcggttagcgtcagagttaaactgccatcgctgctttcaagtgcggctttttgggctgcggtgaggtcaaagctcaaggtgccatcgttattctggccgttgttattcaaactgacgccataagctttgccaccgatcttcaacgcgatgtcactgaacttggtgaagcctgcaccttgatcgttgtagttaacggtgacgcgaccgttttgatagctcaggcctgtcagggtcggggcaacggtatcaacggtgaccggcaagtcaaagtcctgattttgctgggcgccggcgttatattgttcggttaccagccgataagtgtatttgccgtctggtgcagtcacatatttgccagttgcttggtcataaaccttgccgtcccaagtgaaggcatttggatcttagtttcaaccggttttgctccactggcatttgtctttgtattgttgacgcttgtgttagacgtccttatctacttcccgtttattcgcgtgtatgatcca

SEQ ID NO: 172 - DNA, 981 bp, Lactobacillus rhamnosus
attttcttggctgaagtggccatagcctgagctgccgtcatcaaggaagacgaccatttcatctccgttggcgcgaccggcttgttcataggtgccaaaatccgctgtcggtgcgaggacggtgccgacaaagtcaccatatggagcggatgcggttaagttaaaggtgacattgccggttttagtatcgactttaccggagaagactttaccactcatggcatcggtcgcgtatacgatccaatcaacgccagctggaacctgagcataggccgtaaagctggtttggtcggacaccgcttgaacgaagccatctgtacgccagtggttgtatggaccatcgccaactttccagctgaactgcggtgccacattggcggttgttgctgttggcgttgttgcttggtgggtaccggtgacggcctgcagcgttttgctggttttattaccggcaacatcggttagcgtcagagttaaactgccatcgctgctttcaagtgcggctttttgggctgcggtgaggtcaaagctcaaggtgccatcgttattctggccgttgttattcaaactgacgccataagctttgccaccgatcttcaacgcgatgtcactgaacttggtgaagcctgcaccttgatcgttgtagttaacggtgacgcgaccgttttgatagctcaggcctgtcagggtcggggcaacggtatcaacggtgaccggcaagtcaaagtcctgattttgctgggcgccggcgttatattgttcggttaccagccgataagtgtatttgccgtctggtgcagtcacatatttgccagttgcttggtcataaaccttgccgtcccaagtgaaggcatttggatcgagacgcatatccgtgctcagtcctaagtcagagttgtagctattcccattttgcagataggacttggttgtgttgttttccttatccaacacgcgaaccacatggccttgtgcatctag

SEQ ID NO: 173 - DNA, 509 bp, Lactobacillus rhamnosus
atcgaaatagcgcatccccagtgtgtgcaatttagcaaacagttgccggcgcgcatcttccaatccacgttcagcgcccatgttgaacaagaaggtttggaagaactgaaatacggccttaaccagagtaccaaatgcataaagcaccgcaaacagcagcagaatctgaaccgttgcactttgatttgccaaataacgatcaaaccaatcaggttatgttgaacatgctggattcgcatgatacgccgcgcatcctgacgctggcgcatggtgatgaagttctggcattgcaggcgttgacgtttacctttatgcagactggtgcgccatgcttgtattatggtaccgagatggggatgtcgggtggcgatgatccggatgaccgcaagccgatggactggagcaaacttggcagcccgatttggaaaaaggtggcggagctggtacactttcgccggaaacacgcacagacattaggccaaggcagcactaggatgtcggtgactgcg

SEQ ID NO: 174 - DNA, 832 bp, Lactobacillus rhamnosus
gatccacgcaccatgcctaaacttgccaatgcgttagccagcaaatttgccaaagaaaagccggcaaaaaaggcgacttttaaagccaatgccaagaaatacatcgcctcgcttaactccctcaatgctttaattaccaagctcaagcaaaatgttcatggtcaaaaagtcgatgtgtccgaacccgtcttcggctatgccctcaattatctgggctacaaagtcaacaaccgtcattttgcccaggcaactgaagaaggtactgattacagcgccaaagatatccatgcgattgaaaccgacatcaaagaaaagaaaatcgccttcttcgtcaataatagccaagccagttcaaaaaccatcgatagtttcattaagctagccaaggaaaacaaggtacctgttctgaacgtcaccgagacactgcctaaaggaaaaaactaccgcacttggatgactgatcaatatcgacaactggaaaaaatccaaaatcagacggacactaagtaaccttcttgaccgcaaaacctacgagtagcatgcgtttaaaacatgatagtttgtgaagccatgtgacatatgaaacattttcgtaaactttttgaaatgaattcgttttcatgccccttataccaattgaatttttgaccggttgaactacaatagagttgtaaacaggagcaaccaaaggggagatgttttaaatgtcattgttcaaacatacttttaaacgcgttgagcacttgatcgccgcaccacgcgatccccacgaagaagaacaagcacgtttgcaggaggacttgttctatacaaacctcagtagcctccaacc

SEQ ID NO: 175 - DNA, 801 bp, Lactobacillus rhamnosus
gatcagaaaatgcctgatcccagcgctttgatcacgaccatgattcggcttgcaatcggcattgtgcgccaagggattaatcagccggtgaatagttatcatcggattgtggagcaaggcgacagcaccacgtttaccgggcagttgattctcaaagcactggcgttttacaacttgccagtttgggccgacgactttgcttattaccttggagcagatggtcagaagttaacggtggcacagaacgacaactttgtggctatgacgcaccgaattatcctggcagttggggcgctggttgatcacgatttcagtcacgacagtcaacttcaggaaaatctctacctgcacctcagccagtcgcttggcaaggagaatcaactgcttcaatacagtccgtttacgcaggacatcaagcacgaatatccgcagttgtttgcagcaattgaaaagacggtgcataaggagctggccgcctatcgcccgattttgaacgatgcatttgtggcctttatcgccttgcatttcatggtatcgctcaatcgggacagccaactgaaaacggtgcgggtcgcttatatttgtgccaccggtattgggatcaccaatctgattcaacagcgcgtggcttcggcgatacccaacattgaattggtcggatttgcctccattgatgatgcacgggcgctgattgcccgcgagcatcctgagctggtgattagcgttttcccactgaagcatctggatgtgcaagtcattgaagtccaaccgttgccaaacgcgactgatattgccgctatc

SEQ ID NO: 176 - DNA, 938 bp, Lactobacillus rhamnosus
tcatagacgatcacaatggccaggtcaaaacccgggaagtgcgaaaactacggtaacggtgatcccgtccttagctttattttaacaggaaaaaccagtagaaaaaaggataaagctcggtgatcgtgggccagcgctttataagaaagttgttgatcatctgctggacaggtttcatttgtgaacggtcctgcagcgtttgggcgagtcacttacttttaaatcacaagtaactctgttaaactggcataacgagaaaatggataagcggtgctgcgagggcattgctgtgaataaggagtctgtatggaaccagcagttaaatatcgtctcattcatcaagataagcatagtggtgcccggttaggtgaattgatcacaccgcatggaacttttccaacgccgatgtttatgccggtgggaacccaagccagtgtcaaaacaatggcgccagaggaattggacacaatgggagcaacggttattttagccaacacctatcatttgtggttgcgtcccggtccggatttaattgaagaagccggtggattgcaccgtttcatgaattggcacaagggaattttgacggactcaggcgggtttcaggtcttttcgctagcagatacccggcatattacggaagacggggtcaccttcaagaatcatctgaatggcgcgaaaatgttcctatcaccagaaaaggcgattgcgatcgaaaacgcgttaggccggatattatgatgagttgatgagtgtcgccgtttttgagagttatgattatgtcaaaaaagtgttgcgcgaaccagtcgctgggctgagcgggggttaaaagcgcataaaaatccggattggcaagcgctgtttggtattgttcaaggagccggcttcaaagatcttcgtgaacaaagtgccaaagacttggtaagcatggattttcc

SEQ ID NO: 177 - DNA, 767 bp, Lactobacillus rhamnosus
ggattttcatttgacggtggagccgtaaatttcggtgccgtaactcagggagctcagcaaactgaatcccagattcaggttactgacaatctgtatatcaatggaaatggtgctgtacgggtttcaacacccacagatgtgaatggtattccacaggtcattaattcttcactttcattgctggaacaggatgacagtaatgccaccattaaacttgtagatgcaagttccgcagttgtaaaggggaatggtggaaaccttcaactgcaggatgcctccgggcaagtaatatcctcaggtaagcaaaggaatatagttcaacagggaaaaaatgttgctaaggggtatacgattatcgtctgacatcagggccccataatgatggactgtatataggttatgctctgactcagcttgatttgctagcctctggtgttgatgcactcgtgcttgatgctgcagtttatggtgattctcctgagctacctaagaaagaagacatggccgttaaaccgctaacccaatatgcagttgacaaatttgccacggaacgcgcggttttgaattatggccggctttatgacatgccaatggtttgcacgcgctttttcaacgtatacgggcccgaagcaaaaccctaaagtcgccttatagtggggtattgtcgatcatgatggcggcgttgcaagaaaacaaaccattcaccttctttggcgatggcgaacagactcgcgatttcatctatgttggtgatgtggtgcatgcga

SEQ ID NO: 178 - DNA, 1322 bp, Lactobacillus rhamnosus
caaggcctttccgtttcttttctagttctatgaaaggaggtaaaacatgttaggtaatctcggacgaattgcggccaccgtaagcttgaacattgatccgtttcaagtgagccagcgagttttgaactcttcaattaaagcaactgccgctgagttgcgggctcaagatgctgcgtttaagggctctgaaaagtctatcaacaacatgcgttcaacctatgacacattgagccgccagtcaaagaactaccaagctcagcttcagaaacagcgagaacggtatgatgaaaattcgaaagcggttgaaagacttaataaaagtgagactgcatcgcaggaagaaattaatcgtgctacaaagctgcaagctaatgctgcatcacagtataatcggactgctgccgctgctgctcaaaatgaaaatcgaatggcggccttacgcaaagagattgcgctgcaaagtgacggctggactaaagtatcaaacggtgcatcaaagtttgcgtctgtcactgaaaagacaagctctaagctaaccagtttcggatcaacgatgacaagggcggtaactgctccaattgccattgggtttgtggcagcagctaaatctgctattgatttcaacagccaaattcaagcaatggggcccttgctaacaaatggtggtgcgattacagctaagtatcgtgcgcaacttgatcaactagcatcagcatctaaaaagtggtcggttgaatatggcgtttccacggctgcaattaacgatggtatgtcagaaatgatcaaacgtggctatactgctgcgcaaactttaggcgctatgcctgcagttctcaatgcggcaaaagcgtctggcgatgacttcaacgatgttatgcatgtttctacatccgttttggagcaatttggtctaaagacagaatcaacaacgggcatgcttaaaaacacgtctcgcgttacagatgctcttacctatattgcgaacgctactgcagcagggttccaagatatgggcgaggcaatgacgtatgtcgggccttctgctcatgctgctggtatttcactcgaagaaacagcggctgctattggtattatgagcaacaaagggattgaaggatcagttgctggcacagcattacgtggtgctttaacaagactgttgaagccttctaagcaaaaccttcaaggctttaatgaattaggcatatctgttgctgatttcaaaaaaggaactttaactcttccagagattcttgacaaaatcaagaataacactaaggggtggacggaccagcaacgtgcttctgcagtagccgttggct

SEQ ID NO: 179 - DNA, 670 bp, Lactobacillus rhamnosus
  misc_feature (1)...(670): n = A,T,C or G
atggcgaactaacacncatattcaaccggatacgggcttgatcaatgatccctgcagtctgaatttctttaatggcaagtggcatctatattaccagcagtttccatttggtccggttcatggtttaaagtcgtgggcgcatgtcgtatccaaagacttattcaactggcggcgggtcccgggtgatttattgccggataacgaactcgatgcgcaaggtgcttacaccggttcggcattagtgacgcatggtacgctgcgaatcatgtacaccggtaatgtgcgggatgaacagtggcatcgacagtccacgcaattaggggcggttctgggcgcagatagccgtttgtataaagatccgaagccattgatcgctaatccgcctgctggctacacccaagagttccgggatccatttctatttaattatcaagataaaacctatgtcttaatcggtggtcaagcgggccgatcacaccggcgccatcctactctatgaaaagcaacccggataagacctggcgctttgtggccccgttaaagtatcccggacgagttttgcggttacatggtggaatgtccaaaacattgcctttattaatggcaaaagtcgtcttaatgtacctggcccaccaaggcttgggacccaagacttttttcaatattgaaa

SEQ ID NO: 180 - DNA, 1731 bp, Lactobacillus rhamnosus
  misc_feature (1)...(1731): n = A,T,C or G
atgcttatgctaaagggcatttaggcataagtgtattgggtaacggtggaggggttggtctccaggccggagctaaggcaagcattgatggcagtgatcttgactcacatgaagccagtagtggttcacgggccagccatgatgctcgtcangaatcgatggncttggcaacagatccggcaacgacacaacaattgagccagacattggcagtcccgccgtttttggcgactttgttgtggcaacgtggcatcaaagacaaggcagagtatgaagcctttgtgcacccggacattagtcggttgcacgatccgtttgccttacacgatatggataaagcggttgccaggattttggaagcaattgagcaaaatcaaaaaattacgatttatggtgactatgacgttgatggcttaaccagcagctcgatcatgttggagaccctgcaaagcctaggtgccgagcctgatgtttttattccggatcggtttactgacggctatggacccaatgcggaagtttacgcctacttgcaaaaaaccggcacgcaattggtcattacagtcgataacggggttgccggtgcagatgtcattgatcccgcccaagcagctggcatggacgttgtggttacggatcaccatgagttgcctgaaacacttccgcatgccgtagcggtcgtccatccccgccatcctgaggggcactatccgtttggcgatctttcgggtgcaggtgttgctttcaaagtggcaacggccttacttggcgagccgccgctagagagcattgatctggcagcattaggcacgattgccgatttggttaagctaaccgatgagaatcggatcatcgcccagttaggattgaaaatgatccaaacgcaaccgcgcgtcggactcgccgccattttaaaagaagccggcgtggcaccggacacagtcaatgaaaccacggttggctttgtgattggtccgcggctgaatgctttgggacgaatgggtgatgcgaatcccggggtgacattgttgactacctttgaagaggatgtcgctgccgacttggcccaacaagtcggcaagttaaatcaggagcggcaagggttggtcagcaaaattgcgcaagaggctctcaccatggcccagacgccggaaaatcaagcggctaaaacgctgctgcttgccagtaagggatggcatgaaggagttgttgggatcgttgccagtaaagtggtggaggctaccggtaaaccaaccttgattatgaacattgccgatgatggcgacacggcaaaaggttctggccgttcgattgcagcgtatcacttgtttaacgcactggaaccggctgaggacaaaatggttcattttggcgggcatcatatggcagttgggttaacggctaaaaccgctgaactatcagccatccatgcgcaaatggaagcagccgctgccaccatgctcaagaccgtgcctaagccagcgcttccgattgctgcgcgtctggaagttggcgacttaacgctagagcattatcaattaattcgccagctagccccatttggacaaggtaatccggaaccgactttttccgtgcgtccccaagtggttcagaatgtgaagccgatcggtaaggaaaatgcccatcttagatttcaaattgatcaaggcgtcaatgtcatcgggtttggttttgggtctgcagcggcaacattagctgaggctcaagcta

SEQ ID NO: 181 - DNA, 2048 bp, Lactobacillus rhamnosus
cacaccttttggaacagccaaacggtaactcgctgggcttaattgccaatggtccgcacgtgcacgaatacttacgtgcgatgaacaaggcggttttgtccaagcacgatcttatgacagttggcgaggcacccggcgttacgcccgccttggcacttcaatatactggtttcgatcgccacgagcttgaaatggtcttccagtttaaacatgttggccttgataacgatccacaattcggcaagtggtcactcaaacatcctcagttgaccgatctaaaacgcgtcctatccgattggcaaactgcactacacggtaaggcttggaacagtttgtattgggataaccacgatcaagcccgcgctgtttcgcgttttggggacgatcgccctgcttttcgggttcactctgccaaaatgctcgccgccactttgcattttctggaagggacgccttacatttatcaaggtgaagaacttggcatgaccaacgttgccttcccatccattcacgattaccgcgacctcgacaccctaaacgcttggcatgaacttgttgaacagcaacatgctcttgcgccagaagatatgttaaaaagaatccaccgtcgttcccgtgataacgcccggaccccgatgcaatggtcacctgcaccgcaagccggcttcaccgcaggcactccttggctagccgtgaacccaaactacacggacattaacgcaaccgctgcactggcagattccgattcggtcttcttcttttatcaaaaactcattcggctgcgtaaacaataccctgatctgattgtttacggcgcttacaccttactcgacccagacgatcctgatgtatacatgtaccagcgccacgccgccaaacaagaactgctcgtcatcagcaacttcaccgaccagacgttgactcgcgatatcgccaaacagctgtcaccttcagccaagctactcatcagcaactatgacgacgacgctgaaaatacgctccggccttatgaaactaaagcgtatttgaccagtgagcgatagtgagttcacttttgatctttaaaaaacgcaacgaatctcattcggaggttgtcaaaatcccgtcctcaccgatttttcttcatgtagaacgcgtctacttgccattacgtaacgatgcggccacatcaagataatcatcgtgatggcatcggttgattcgattctcttttaacggccgtcagccaacttgctactggttatcactagcttcaccgccaattagcaatagttgctggccgttatcggggacgcctcaatcgcgctttacccgtttcttctcccccgggggttctttatgcaacagtgctgttgcgttacataacataaatcattaaaagagaaacgcaaaatagttgccgcagttctatccgcaggcgccctacaaatgccaaaccagtcatggatatcatcggtgccagtggctgatcaagcgaaaggccaacaatgaaaggctatttagcatgccatcatgctttcaccttggatgaataatacaaataccatatcaccgtcacaatttcgtcacatctgctctgtagtattagcaacatagaaatgagccacccactcattcctatacaaaccccaacccaactttttcatttttactcctccaaagtagaaatcgtcagccggcctcccaccggctgaccaatacataaataaacccccgcagtgtgaggtgaagtgccccataattgttagacagatactctaatgattgtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagttggccgtggtagactattatcaaaccagtgggaaggtgtggcatcggtagctgctcatttcgggatc

SEQ ID NO: 182 - DNA, 4105 bp, Lactobacillus rhamnosus
caagaaaatggtggggactatggcgaaaatagatgattcagttaaaaagaaagttccagaattgcgatttaaaggtttcactgatcggtcaactgaggatgtttgagtgaccacttgccgaattgtggatcgttatcaaggccaacatgtttaaactggaagaccatttcaagctcgtggcgatcgaaaccagtatattgaagtgccaaggcgggcgtaacgccgggtgcctcgccaactgtcataagatcgtgcttggacaaaaccgccttgttcatcgcacgtaagtattcgtgcacgtgcggaccattggcaattaagcccagcgagttaccgtttggctgttccaaaaggtgtggatcatcagcaaaaacatcaggctttgaaatcagattgataacatccattcgaaagccatcaatcctttgatcacaccaccacgtcatcatgtcaaaaacggccttgcgcacagcaggattggtccaattcagatcaggctgtttgaccgcaaaaaggtgcagataatactggccgacttccggtacatacgtccaagcggagccgccaaaatccgcgcgccaattagtcggttcatgaccatcgacgggatcgcgccaaatataccagtcatgatggggatccgtgcgactttgtttagccgcctggaaccaaggatgttcgtcagaggtatggttgacgaccagatccatcatcattttcaaaccgcgggcgtgggctgcttttaacagttgttggaaatcggtcatggtaccaaactccggcatgatttgttgataatccgcaatgtcgtatccgttgtcggcgttgggtgatttgtaaatcgggttgagccagataacatcagcgccgagttctttaatgtaatccaaatgctggatgataccttgcaaatcaccgataccatcgccgttactatcttgaaaactgcgggggtaaacctgataaaccactgcttcttgccaccaacttttgtgcatgggaaaagaacctccttgtgagtgagcatgggcctgaatctgagcatcgtggtgagaaccagtgcactgcagccaagctcctaacacactgatttttgcgcagacaaacagacgatgatcattagtttcagtataaagtttcaaaccatatgtgcagtaaaaatgctgtaaaggtttagttgttttgccaagcgtactgacgagccgaactataatgtttaaaaagcgccatgttatactttttctatgagctaacaaagtcgataaggcagcgtaacgccaacaattaagtgaggtttttaaacttgaaacagactagtgaaagcagacggcgtcaacgaccacctaagagaaagtggatggcgccgttagcagttttgatcctggggttggtcattatcggcggctatttttatattgcccaacaacaaacaaagcgtggactgactgaatcgcaacaaagcgcgatcaaaaaggtgacctcaaagcagcatgcaagtaaaagcagtgcggtcaagccaagtgatatgggggaaagtcgggggcgcagttctcagtcaacagctggtagtcaagattatgttgttgatgttgccaagcttttgcgggaacgttcaggggcggtttttacacgacaaggcgtgaatgcgccgactcggattgagttgcaagcggacccgcagacagcaaattatcgcctgaccattcagtatcaacatgcggatgccgtcacgatgaaagcgaccatccgcaatgttgcaactaaaacaatcaaggtcttcagtgctgacgctgcaggccaaacgcggaccgtcaaatgcaacaccgagattaaagtgggatcgttcaccgatgaagggagccattcgcaaaccgcagcgaacatgattggagataagttttatctgttttacaacgcacacggcaccgtctcattggtgacaccgaactatgcgggtaatgtggagacaaaggccgacgcggcgattatgaatgagtatgttcaggcatcggctgcggagtgatgttttaatacgttgggagtcaccatactttcaagcctcacataatcagtcatattgaaaaaatgttttactaacatcagaaatccggataaaacataccatccaaattaataacatatattgttataagtgtaagaaatctcttaaaaaaacaaccgaataatttaccgacacaacttcctttggtactttgacctaaggagcgccaggactgaatactagagataattcgcagtcaagttgcttattttcaaacttgttaaatagcaatgaacagtttctttcaacttgatcaaggtgctttttgaaaacagaaaggaaatgctcggggtgagaagattaacgattgaaacagaggagacactttataaagttggctttgtgagtgcattggcggtggttattgcgcttacgctttggtggacggtgtacagagatggtggtgtcgcctattatgcaaaagtacatgaaccacgcagccaattttcggtgacagttccggttaatctgcgccaaaaatgttacgtttatcgagcgttggcgaaagatgctgctgggcgcgggaagctacttgagtttaagacggatgagtatgatcccggccccttctctgacggacaaatactgcgcctgacttataatacgcgctatggtgtgactcattatgagcgagtttcgatcaatgaggttccgcttaaagccagagattaataaaacaaggaagactgaacacaataaagcaccaggaaactcagcgttggagttcctggtgctttattattttgtgcttgaattcaaaccacagctagggccaagggaaaagatcaattacttacccggtacatagtctttatcaataatcaaaaccggtttaatggtcttgccagagcgggagtcagcattggcttcgttgatctggtcgaattgatagaatttttcggttttatcaaagtcgaacataccttgcttatagaactcaattaggcgcggtacgtcaatttgtgggatggaatcgcccatgttgacgccgacgatcttcttgtcattgacgcagaggtcgttccaggtatcaacgtcaatatgatgtggcgtaaccgcgatcgttgcggtggtaccaccctgagccagcatctggatcgtatcttccatcactgccttgacgccggttgtgtcgacagcccagtcaaccccgaggccaccagtcaattttttaactgcggcaaccgggtcttcggttttgctattaacgacatcggttgcgccgagttctttggctaattcgagtcgggaatccacaatgtcaatcgcaatcactttggtgcatccggagatcttgcccgccatcattgcggctaatccaacggcgccagtaccggtaaccgcaatcgtatcaccaggctttggcttgagcgtattcaaaacggttccggaacctgtgacatagccgcagccaagcggtccaagcttgcgcaaatcaagatctttgtcaactttaaccgcattacgttcacgaacgaccgtggtagttgtgaaggagctttggtcgaacatgtctgcgaccggcttgccattttcagtgaagtgcgcggagccatctggccgggtaccggacaaattgttatgggcgtaattaagacactgggtcggaatacccttcaagcagttcttgcagttgccacaggcataaaagcttaaaacaacgtgatcgccaggtttgaactgggtgacttccgggccgactttttcaacaatccctgaaccttcatggcctagtacgatcgggtagccgataacggcatccccgatacgtaaggcttcgtcggaatggcaaataccactggcgaccatatggacttgaaggtcgtcaggacccatcggcgctagttcaacatcgtcccgaattttaaaatcagcacctttttcatcaacaacggctgctttgattttcattgcaatctctccttcacttgctcatcatttgattacacgttcattgtttcacaataaagaaaattatcaagcgccgtttacaaacatctaaggatatgtcccaatgtttaacttgactttttagtttcacgg

SEQ ID NO: 183 - DNA, 1846 bp, Lactobacillus rhamnosus
agttatgtgccttttgggactgaaattgatcgcttgtacgcttacgaacgagttgctggcgatgcccacttgctggtactgaataatttcagtgataaagccattacggtaccgctaccgccacgtttccagcatgcacgcgttttgataaccaatgaagcagatttaacaccaactgcaaccatgacgttgccaccatacgcaacgattgcattgttgcagtcagataagggggaataagcaatgcaaagaaattgcacttaatggcgccggtttccggattggcgatggccattaccgatgtttccgatccagtcttttcacagaaaatgatgggtgacggttttggcattgagccaaccgatggccaaattgcggcgccggttgatggacggatcatgatgattgccgataccaagcacgcaatcgggatcaaagccgatgatggcgccgagttattaattcatttagggatcgatacggtcgaactcaaaggcgcgccgtttgaaattgatacggcgatggatgcacgggttaaagccggtgatgtgattgggtctatggacttggatgcaatcaaaaaagctggcaagaagaccacggtcattgtcgcgattaccaacacgaaggaagtcgttgatcagctggacgtgacgcccggtgaagtcaaacgcggcgaagaagttgcggtgatgacacctaaagcggccgcggttgaacaagcaccggcaacaccgaagaacgaaagcaagtatgcggccacagcgcggcaaatcattgcggatgtcggtggcgcccaaaacgtcaacagtttgattcactgtatcacgcgcttgcggctctatttaaaagatgaacaaaaaccggatgatgacaccgtccgtaacattccgggcgttattgatgttgctcgggcgaatggtcagtatcaggtcgtcattggccaagcagtgacggatgtttacgatgaagtgatcaaacaactcggccctggttattcgaatgcagaaggaaccgccaaggccattcaagaaacccaagcggaagctaaagataccagtgcacttggcacgatcaaacgttgggcccaggcattgatcggcaccattaccggttccatgattcccgttatcggacttttagccgcaagcgggatgttaaaagggattttgaacattctaacaacatggttcggtctgaaaaccacaaatccaacttatgaaattattaatgcgatgggcgatgcagccttttacttcttacctgtcattgtcggcttcaccgctgcccagaaactcggatcggatccggttattgtcggaattatcggggcgttcctgatttatccgtcaattgctaaaatcgccactgccggtaaagtgaccggcacagtgttgggcatgggcatcaacgcgaactttttcggtttgccggtgcacattgccaattacacgtattccattttcccgatgatttttgcagcgtggatggcggcaaaaatcgagccgtggattaagagttggatgccgctggtactgcgcatgattttcacgccattagtcgaaatcttcctggttggtatgacagttgtcttggcagttgggccactgatcacggttctctccagcggcatcacagccggtattcaggcgctgctcagcttaacgccgatgatttccgatgcgattatcgccggcttctatcaagttctggttatcttcgggttgcactgggccgttattccggtcatcaccgcgcagttgtcatcggcacatcccgagtccgtgctgaatgggatcgtatccatttccatgattgcccaaggtgccggtgcattggcagtctg

SEQ ID NO: 184 - DNA, 1788 bp, Lactobacillus rhamnosus
  misc_feature (1)...(1788): n = A,T,C or G
ttattctgatcggttgaccaaagatttagtggcaatgaataagaattcggcagttgtcaaagcacaacgaaatagtgacgttaatattttcaccaatcaaagtattgatgatgccaccaaggatcacgcaatgtggcgcgcactggttcaagtaagtcatccagctcaacaaaatcaagcgttgccggacttttgaccactgcaagtttcggcagtaaatgatggttcttggaaatctcgcggaataccgctacattctctgctaagcccatgagaaccagcggcatttttttaggattcgaataatttntcngnnaatntngatccgctggagtcatcttcaagtgctttgaccccggaaattgtcggtgaagaacattataaagtcgcaacagaagtccaacaggttctccaacgttaccgtgagttgcaggatattatctctatcttagggatggatgaattatcagacgaggaaaaggttatcgttgcccgtgctcgtcgggttcaattcttcctgtcacagaactttaacgttgcggaacggttcactggtcagccgggttcttatgtaccggttgaagaaacggtcaaaggctttaaacaaattctggaaggcaagtacgatgactatccagaagatgcattccgttcagttggacggattgaagaagtcgttgaaaaggctaaaaagatgggctttgctcctaatgatcaggacacggatgctgacgaaaagccagctgcacaagctgcagctaactaaggaggcgacgcgttttggcagaaacgagcaatgttctgcgggttaacatcgtgacgcctgatggtttggtatatgaccatcatgcaaagatgttagtcgttcattcggtcgccggtgaattgggnatcagccgtttccttaagccagtcctgctgttgggtcagatattcataagcttccttgnacgtgactgcttcaacccggcgaacccctgcgccaatgccggattcgctggtgatcttgaacagacctagcgcattggtattggttgggtgggtgccgccgtcaaattccttgttataatcgccgatggaaacaatccgcacgacatcaccgtatttatccccaaacatcgcaatcgcaccaagtttcttggcttcagcaattggcatctctttccacgtaatcggcaaagcatcccagatcttctgattaacaatcgtttcaacttcgcgcagttgttttggcgttacctgaccgaaattagtgaagtcaaaccgcaaataatcaggctcgactaacgaaccggcttgatgggtatgctcacctaaaacatcccgcaacgcctgatccagcaaatgagtggccgtatggttaagtnaaactttctgacgccgcaaacgatcaacgctgagccaatatggctgtcccttcgtcaatttgcttttaacggtaacggtatgcaggttttgaccattgggtgcatgctgaacatccgtcacttcggccaatacggtgccatcctgagctttaataaccccgtgatcagcgacctgaccacccatttcggcataaaaaggcgtttcgtcaaaaatcagttgggcttgcccggtgctgacttcatcctgaagctgatcatccacaacaatcgncngtaacgtggcagttcttacttttgttaaaagcaaggacaaggaggttatgatggcgtttcataagaaagttatttatcagttatatcccaagtcgttttacgatagcgatggtgatggtgtcggcgacttacgcggcatcattgaaaa

SEQ ID NO: 185 - DNA, 555 bp, Lactobacillus rhamnosus
  misc_feature (1)...(555): n = A,T,C or G
gatcggatttagttcatctcacatgcaatccttgctcaggtttggtagcgagggatctcatggtgcacagataaccttatcttgttcaatgtatttgtgttttcaatgtcaatgaagagctattaggaggattttaccagtggaaaaatggtggaaaaacgcggtcatttatcaaatctacccagctagttttcaagatagcaataacgatggcgtaggagatttaagaggtataactgagcgattggactacattaagaaattaggtgtagatgttttatggctaagtccaatctataagtcacctcaagtcgataatggatacgacatttcggactatcaggcgattaacccaacttttggtacgatgaaagactttgacgaattattagcaaaagcacattcacttgggcttaaaatcatgatggacttagtggntaatcacacctctacgaacatcattggttccaagaatcacgaaaaggcaaagataacccgtatagagactattacatctggcgagatgggaaagatggcacagcgccaaacaactgg

SEQ ID NO: 186 - DNA, 791 bp, Lactobacillus rhamnosus
  misc_feature (1)...(791): n = A,T,C or G
cggcatttaaagacacttcgatttttgatgtgattaaagaacgtgatgttttcatgcagcatccgtatgacagctttgagccagttgttgactttattcgggaagctgctcaggatccgcaagttttagctgtaaaaatgacgctttatcgggtgtcgagcaaatcacccattatccgttaccttaaaaaagcggcggaaaatggcaaacaagtgactgtactggtggaattaaaagcacgatttgatgaagagaataatgtccactgggcgcaagaacttgaacatgccggctgtcacgttatttacgggttagtcgggctgaaaacccattgcaagctcgcgttagtggtgcggcgtgaagaagatggcattaagcgctatatgcatatggcaaccggtaattacaacgatgtcaccgcccgcctttatactgatatgggcttgttcacctgcaataacgaaattggcgaagatgcgtcaaacattttcaatatgctatcgggattttccgagccgccttatttccacaaattagtcattgcgccgcttggcattcgtgattatctaatggatcgggttgacgaagaaatcgcggcagctaaggccggacgcaaagctttgatccaaatgaaaatgaactcactgtctgataccgccatgatcgagaagctttacnaagcctcgcatgccggcgtcgaaattcatttactgattcgcggcatttgcaatttgaaagtcggaatccccggtgtttcggataatattaccggtcattccattgtcggccag

SEQ ID NO: 187 - DNA, 801 bp, Lactobacillus rhamnosus
attcttcaccgggtctgcttggaaatatgacgctcagtcaaaccagtattatttacacttgtttgcccctgaacaaccagacctaaattgggaaaaccctacagtacgacattccgtttacgacatgatgaactggtgggcagacaagggcgttgatggatttcgcatggacgttatcaattatatttctaagcctgagggattgcctgatggtaaaaaaggcaaacaggaattatatgctaatcccgaacccttagttgccaacggacatcatgtccacgaattcttgcgagaaatgaatcagacagtgctgagcaaacacaatttgatcagtgtcggcgaaaccccaagtgtgacagttgacgagctgaaaaatatgccagccttgacaacaaagaactaaacatggtctttcaattcgaacatatgggcttggacggcaattcaaaccccgccctaggacgttgggccgatcgtaaggcttcgttaaaagatcttcgcgccaatctgaccaaatggcaattagccttagccggaaaagcatggaattccagagaaagtactttcaacagacgcttcgttaagcttggagtttgtgatgcaaacttctgaccaccttcgcaagaatctcttgttgtcacccgtacgcataccaattccagcaaacgcaaaatcagagattttttcttttgaaaacacattaagcaacgaacctggaacccagtatgctaaaggggtgccgggaatcttctcaaagttcgtttgtttagtacgattaaatcggtttccatgaatcggcaa

SEQ ID NO: 188 - DNA, 3089 bp, Lactobacillus rhamnosus
  misc_feature (1)...(3089): n = A,T,C or G
agctcattgtggcagcagcggcgatggnacgatcaatgaggttgtcaatgggattgcgccagccaaaaagcggcctaaaatggcgattatccccgccggtacaacgaatgattatgcgcgggcactgcggatttcccgtgatgatccggttgaagcggcacgggttattttaaaagggcagactttggcgatggacatcgggcaggcgaaccatcattattttatgaacatcgcagcaggtggtttgttaagcgaattgacttattcggtcccatccgaagtcaagtctatttttgggtattttgcttatgtcattaagggtgccgagatgttaccagcggtgcggacgatgccgatgaagcttgaatatgatggtggtgtctatgacggaccagccagcatgttctttcttggtttgaccaattcagtgggtgggtttgaacaaattgtgccggatgccgagttgggtgacggtaagttctcgctgattattgtcaagactgccaacatggccaatttgttgaaattgatggcgcttgtcttcaacggtggacgccatgttgatgatcccaatattgtctataccaagaccaaaaaactaaaagtcaaaaccagcggccaagacacgcttaagatcaacctggatggcgaatatggcggcgatgcaccgatgacgtttgttaatttaaagcaacatatcgcgatgtatgctaatgtagacgagatcccaaccaagaatttagggacggatgcccagaagcaaagagactacatggcagaagtcgaatcgatctcccaccgcgacattgatggggatggtcaaatcggcgcacaagatgaaaaggatgactaatttggcccaaccagctgtaaccaagaatcaggatctggaagttacgattgaggatctcacttatgaaggcatgggcgttgcgaaagtcgcgggttttccgctatttatcgaagacgcgctgcctggcgaaaagatgcaggtacatgtgcttaagacccagaagcaatacggttttgccaaagtggtgaagcgactgaccgactcgcctgatcgcgtggccggtgctgacagtacttacattcgcaccgggattgccccgttgtcgattttggcttatccagcacaattaaaattcaaacaacatcagatccaggaactctataaaaaggcccacttggcgatcaaagtgttgcccncaatcgggatgaagcacccactaggctatcgcaataaagcacaagtnccagtgcggttggttcatggcgaactgcagactggtttttataaaaaacacagccatgacttagtgccgattgaggactttctgattcaggatcctaaaatcgatcaggcaattgttgtggttcgcgacttgttacgtaaataccaggtgccgccttatgatgaacgtacgaaccgcggcgtgattcgtaatattatggtgcggcgtggacgggcaacacagcagatgatgatcgtgttggtggcgcgcacatggcaagtgccgcatctgaatgatattgtcgaaggaatcacgttggcccttccggaggtcaccagtgtggtggttaacctgaatgataaacgtaccaatgtgattctcgggcgtaagtcaaaaacaatatacggccgcgactatcttttagacaaactattaggtagtgagtttcagatttcgccagtcagtttttatcaggttaatccgattcaaactgaggtgctttatacgaaagccattgaagcagcggctctaaccggtaaggagaccgtgattgatgcgtattctggcattgggacgatttctttaaccatggcgcggcacgcaaaacaggtttatggtgttgaagtcgttgaatcagcggtgcgcgatgcaaaggctaatgcggcgcgtaatcacatcaaaaatgtaacgtttgaggttggtaaagcagaagacgtcatgcagaagtggaaagacgcggatttgccagtcgatgtcttaatggtggatccgccgcgcaaaggcttggataaaacctttatcgatgcggtggggtatatgaagccgccaaagatggtctacatttcctgcaatcccgctaccctagcgcgtgacttgcagttgctggcagcgtttggttatacagccaaagaaactcagccggtggatatgtttccgcagacgcagcatattgaaagtgtgacattactcgaaagtatgagagaataaccaacaagtgttgatataacagtggctaaggatgattttaagtataaaaagctcatatgataatcatggtcagtataattttacgtttccttttttctttagtatacgatgaattagaatagtactttgagtgggttagcatttcatttaattattccagaaaatggatgcgatagaagtcacgttaaatactgatacagcaagtgtagatcgaagttattaaaccgaggttgctgaaaagtcccaaatcgtaaatttgataatcccaaatcccaattatctccaataatcgtccgtccagtggggaacaccactcgcaaatcgatctgttatcaaggtatttggagggcccgtttttacgagatttagtttttcagcagcctctattaaatcagtagatttttcgcctaataataactaaacaaaaatggctataacaagatacatcacattgaaggaaagaaaaccacaatatataactaacgaaaagaagatggattaatcataatattatcctaaaaaataatacggagcatcaataataattgattctattaattggcaagagtttaagaacttgcttgcgcaaaaaggcgcggatgttgctactgatgttttgaggagggtttcacagagccatagtgtgcaatcttttgaaaatccgtaaagccatacgacttaattcgaaataggagaaagttaatgcaaactgataatgaaaagtacaatgaaaaggcacagcctaatactgcctttatgaatgaactgaagaataaactgccagagttttttacgaaggatggctcttttgatttggaaaaatttgtgggacagttaaaagacaagaatgttgatgaactcagtgaa

SEQ ID NO: 189 - DNA, 1673 bp, Lactobacillus rhamnosus
ctagattaatctatgcctctgccctttgtcaaactcaactagactaattgactcgcatttttaatctttaacaagaccgaatccaagccggcttgatacaattatccgtttcacattcaacaaatctttatgatcgtaaatcaatactcacactttttgaaatatcagcctaaactcatcagccaacgaaagcggcgcaacactatatggcacgtcatgagtcacaagtcctaaaacaagcttctcacgtgctgcctcatccaattttgtcaaatcaataagcacctgatcacgatcaatatctaatatcgcatccgcactaacatcggttaacagctgaggtgtctgccgcatttttaaaaagtttggttggctctcatgcatattgatttgtttgacaatcttgcccgcccgcagaaaaagaatgcgatcggccaggctttgtaggttgtccagtaaatgcgagaccatgatgacgagcttgccattttctcgcagttgctgaatttgacccgagatcagcgcaacattttccgggtcaaggccgttcatggcttcatccagtaacatgatcggcgtatccgaagccacgaccattgcaaaacataggcgctgtttcatcccgagcgaataggtgctgactttttgggtgatataactgcgcattttcagaccatcaactaaggcatcgagcgtgatctgactctgccacatgtttcggtacaatttcaaatgttcatagccatttagctcaccaaaaagttcgctttctaaagggaatgcgcaaattttttgatgaatcgccttaatcgcttgattgctttcgtagcgcagcccgtccacctctacatagccacggtcaggctttagattattcatgatgacattcaaaagcgtggttttacctgtgccattcggagccacaagtccgacaatttctttctgattcaaagtgagcgtgatgtcatctaagacctgctttttgttggcaaaggacaatccaatatcgtttagctttagcatgaagccacctctctctttttcggatgccgtttgtgagtcaggcaaaatataacgacttcaagtacgactatcacactcagaatcatgattaacccgaacacgaaggtcattttggtcgtctcatacctgaagttttgaaagcctaccaccaaccggccgatattgaagtaactcggcagcaagtataacgagttgtgattaatggcgactaagccgggtagaaaataaagactttcgctaactagcaacaggattgtcaccgccaaactggcaaactcacttttcaagattaactgtaagacaacctgcagacgaatgatcagccatacgcttaacagtaaaagaacaagggcttccccgataaactggcctagcgaaattgtgctgaaagtgagcccttcatacaccggtatcggtaaggacagactgccaattccgaacttgatctaactgttgaccccaagtgtgcaaaatgttgcgcagtgccttgaagtcgtacggcattttgctccacttttcaccgttcttataatccgttttcagatggtgaaattggaaaaccattgataactcgtgattttccggcttggtataggcgattgagttcttaatggtggtcgaactcatttcgcctaccgtgacgctatttg

SEQ ID NO: 190 - DNA, 170 bp, Lactobacillus rhamnosus
tcgattatctcaaggcgctgcacatcgacatgatctggttcaacccattctttgtgtcgccgcaatatgacaacggctatgatgtggctgattatcggcaaatcgatacccctttgatatcaatcccccgcgccgccaaatcattggcaaccacatactgatacttaagg

SEQ ID NO: 191 - DNA, 1410 bp, Lactobacillus rhamnosus
attccttaccaagatcagccattaaatcaggatcaacttgatgattcaaaaagttgtccaccttcaatacgtctgttccaataacttggccatcttttttaatccggtcttccagtaatttcaccacaagcactccttttatttgtaaattttcaatcagcttaccataaaaaacgccgtggaacaatacaagctcactaattcccgaacaaactaagtagccgctttcacagcgataaaagaacgaaacccccgcaatttggcgctaccataaccaaataacgaggattcaataatcaacaaaatacgaacattcaattgtcatactgggtcagattccatgcttcgatcaaatgaatcagcttctggggataatccggatcagtagcatacccatccgtctgcaaagccgaggcggcagtcttataatcttttgcggcccgcaccgttgcatactgctgcggattccagtcggtaccgttaacgaatagcaaggcatgatcccgaatcgaagcagcatcatcgctataaacccgaaaccggccgtcaaccgtgatccatttgtcattaacgtattccttcgtccgtaatactttcgtggtggcaggatccgtccccttaatgccaaataagttatggtaatccttggctaacgtgcttgttccccaatcagactcaagaatcgcctgggccagcgtaatgctcgtcaagacgccatactgtttctgcatggcctgggctgtcggtaccaatcgcttgataaaagcctctttcttcgctttttcagccgccttcttatcgacaattgcttggcgttgtgaaacttcggcttgccgttgcgaccaatacgagctgacaaccaacattgaaccaaccgcaaaaaaagcgatgaccagccaagccgcaatggaaccttctttaaggtaaaacgtcggcgctttttcgccaatagccttactcctttgtcttatcctcacgcgtcaacaacaatttgcggcgtaacacgatcatgtcctgtaatcgcaagccatcagcataaaccggctgactatattcatcaaaaaaatgcttccgaatcgaatcaaatcgaaacccgcggcgcatataaaacctaagattatcaaaatcagcatctccggtacccaccagcatatcctgatatttctcggcgtacaccaaactgacatgccgcaataatcctgatgcaatcccttgcggcggcgggcaggcgtgaccgcgagattcttcaactctaccgtggtcgcattgaccgccaccaccatggcaacgccaaccggcacctgctgatcgtatacgcgaccgatgccatgagtggtaaagtcttctccggtaaagtcgatactaaaaccggcaatgtcacctttaacttaaccgcatccgctccatatg

SEQ ID NO: 192 - DNA, 773 bp, Lactobacillus rhamnosus
agattaaacaagccacccagctaacgagttcaattggcatttcatataataaatttattgctaaacaggcgtctgattataataagccggtggggcggaccctagtgttacccgaacaggcattgctgtttttggatcgtttgcctatcaagcagtttcggggcgtcggcaagaagacactaccaaaactgactgatcttggcgtcacaaacggcaaaacgttacgagcattgtcgcaggatcagttattaaccatgtttggaaaaatggggtttattttatatcaacatgcgcgtggtgttgataatcgaccagttgccgtacacaccgctaaatcgattggtaaggaacgaacatatggcacgccattaacggatgccacggcagttgagacccaattgcggaagctggcggcgatggtggtaactgctttgaatcagaagggaatgcatggcaaaacgttggtattgaaagtcagagacgttgactttgtgacccagacgaaacgattgactcaggaccattattttgagggtgaacaagccatttatacggcagcgtggcaactttggcaggaagttaaactgaccaagctagccattcgacttttagggattacggtcaccggacttgaccctaagcagtatgaaaatattgatttgccgttgtagtaaagcatgtgatatctaaaagtggtttctaaccgggctggctcacgctctgctgaaacgcgttcgccggcgcaggagtctgcgtgtaaggacctcgaacgc

SEQ ID NO: 193 - DNA, 675 bp, Lactobacillus rhamnosus
tctttttgcgtccaaaaactatcgcattaagagcacgattgacaaagatgtttatgatcgcatgcaatttgtcatgcgcgcaacccgtgatacgttcggtcaaacttataccagagtcagattaatccgaaaaccggtgaaacggaaaccgttaaatacccggttcaaaacggatcggttgtccttgataatcaaaccggggccgttctcggctttgttggcggcgttaccggcgaactcaaccatatttataccctccgttcccccggttcgacgatcaagccacttttggtttatgcccctgcgattgaccaaaaaattatcggctcgcaaactgccttagctgatttcaaaaccaatctcgggaacaattacagcgtcactgactatggcggccagattcaaaaccgctttatccctgccactgaagcactggcacaatcttataacattcctgctgttaatctatataaacatatcaagccatccgtaaacgtcaaagcctacatggaaaagatggggatcaacaccctgaccgacaatgactatagtcaacttggtctggcacttggaggtactgattacggggtcgacgttaaggagcaagccagcgccttttcaacattcgccaatcaaggtgaacatgttcccgcctacgtcatttccgaaattgtc

SEQ ID NO: 194 - DNA, 482 bp, Lactobacillus rhamnosus
  misc_feature (1)...(482): n = A,T,C or G
gatatcttntgacaatagctaaaaatcgcgttgctgctgccataaatattcaacaatatcatgatcaacgaggcgattctcatggagcaaactgtgggctgcccgtggtccgcgaatgacgacctccgtatagtccttgatccgatccttcaccagataacgcaccgcaaagctgctgttaatcgcaacctcaccgtcatggcgacctccaagcatcaagtctccggcaatatttagccatcgcagatcagcaggaagattgtcaatggttcgctgaaattgctgataaataggggctgtgtgttccggtccctggcgcgtcaatgaccagtttagaatcggtgagcgctgagcaacttctaagtcattcataggcgcagcaatagtgactaggttggcgactggcacagctggtttgcttaataaatacaacactgccgtcacaccgcccattgagtgtccaatcagattaagctgactga

SEQ ID NO: 195 - DNA, 1597 bp, Lactobacillus rhamnosus
  misc_feature (1)...(1597): n = A,T,C or G
gatcaacaccacatcggcaacgtcaatggcgacatcggttcctgaacccatcgcaatgccgacttctgcgtttgccagagccggcgcatcattaacacgtcacccaccatcgctattggccccattgtttcctgcaattgcttaaccaccgctactttttgatctggcagcacgttggtcacaacctgtttgatgcctaaatcggcggcaacagcctcaccggtttgtttcgcatcgccggtaatcataaccggttgaatatcatgatgtttcaagtaagccatggccgctttagcactgcttttggcttcatccatcaacgcgattaggcccaccaccgtttgatcgactgccacaaaaatcacggttttcccttgctgccccaacgccatggcgcgctgccggaaaagcgcaggcgcatgcgtaaaacgttgcggtttacccactgtataggtatggccttgataatcggcagttaaccctttgccgatttcgttgtgaacggtgtcgatcatctcgacatcaacacggcggcagcagttaatgccaattgtccggatgcaaaattctacgggccggaaaaagtttgtgaaatttggcaaggttggggcgttccggctgaaaagacagtggttgtcaaaccgggcgatgttgtgacaattggcgaaaccaaggtcaaagtgcttgaaagttttgatcgaaccgcattagtgaccgaagacgatccgaatgttcagctcgcgggtaaactaccgcaagatatgaacaaaattgccgtcaactacctatttgaaaccacaggcgggaatttataccacgccgcggattcacattactccaacctatttgccaagcatggtaacgaaaacaaaattgacgttgcgttaggggcatacggcgaaaatcctcgtggcattaccgacaaagtaacttcaatcgatattttacgcatggctgaatcactgaagacaaaagtcgttattccggttcattacgatatctggacaaactttatggctgacccgaaggaaatcgaagcgctatggaaaatgcggaaagaccggctgcaatacaagttcaagccgtttatctggcaagtcggtggtgaattcacttttccagatgacaaggatcggatngaattcatgtatgaccgcggcttccacgatacattctcggtaccaaacgatacgccattcccggcatttctataaaacaggtgaggtggggatcaacaatgttactgaaagactttttggacaaggatttggtcgatattcggcccgaaccggcaaaagattggcacgatgccttgcaacaagcagccggtaaactgattgaacatcaatacattttgccgggttatgtagatgaaattattggcaatgttgaaaagaacggcccgtatatcgtgattgtgcccggcgttgcgatgccgcatgcgatggcagaaagtgaaaatgttttggggacggcgatcgggtttgccaagtttccggcgccagttgttttcgatccggctgatccggaaaaaaaggcgcaattgttctttaccttagcagcaaaggatccagagcagcacttgcaaaatattggg

SEQ ID NO: 196 - DNA, 502 bp, Lactobacillus rhamnosus
gatccttatggccacggtgatgagccgaccgcttccgttatcggccgattggtttaaaccgaacccagaattcccacatcctgcagttgcgcagtgatgttcaggaaggtttggaagccattatgtggctggcaatcggcatgccttcatttagcccgtatgtcccgttttattgcaacgcgaatgacaccgacccgagctattccaaaacaccgaaaacctttgatatcgatgctgattcggcttactggctgcatcgattgcttgatgtattggtagaggcacattacacccagttcattcaagcggatcgtgactatctaaccgccttgaaccgcgactatcgcgaaatgatccaaggctttgacaaaggagccaaagaacttggcgccaaagaattaacgcaatatctgacagacgccaattacaagattgtcgcgcataccaaagcggcaacgaaagccttgatcaacgaatacgtcatggaaagcttgaaactttc

SEQ ID NO: 197 - DNA, 484 bp, Lactobacillus rhamnosus
  misc_feature (1)...(484): n = A,T,C or G
caaggcttcaattttggttcaccgtaaagcctcttttttaatcttttctccccnaaacaaaaacccccgaaacaccattataaaggcattccgaggattccgtttcatcatatttattctatttctcacccgtacgggattcgaacccgtgtttccgcgctgagaacgcggcgtcttaaccccttgaccaacgggcaatgagtggcgctttatcgtacctaaattattctacaggaatccacacaaatgtcaaacatattttgcgttcaagcaaccacatatttgcgtacaagcgaccactttcgataaccctttttaacgctaagttatnatcctataaatgcaatagcagcttatnaatacaatttcttctgtgccgcttggtatgctttaaatgcgccgatagtcagctnccgatcgtgctgactcaacactaacatgtcaccttttaggccggcgttaatgaaatcataaattgcagcat

SEQ ID NO: 198 - DNA, 2746 bp, Lactobacillus rhamnosus
  misc_feature (1)...(2746): n = A,T,C or G
gatcgtggccatggtgaatccgatggcgagtacatcagttttggctggttggatcggcttgattaccttggctggctgcaacgcattcttgaccggcttggtaacgatgcccagttattgctgtttggcacgagcatgggtggcgccacggtttcactggtcgcaggcgagccgagtttgccaaaacaggtcaaggccgtaattgaagattgcgggtacacggatgttgaaacggaactggcttatcttttaaagaagcaattccaccttccaccgctgccactggtaccactagccagcttcatcaattatcggcgcttaggttatcctctccgcgtggtcaacgtccgtcaggctttaacgcgaaaccgcttgccattactagtcatncatggcgctgaagatgtttatgtgccaaccaaaatgggccgcgaaaattacgctgcctccgctggtcccaaagcgctctggattgtcccgggtgcggcccacgccgaaagttactggattaaccccgcggctatcaagcgcacgtgaagcggtttttggatatttcttttancgcttgcactcctaataatagtcgtcatgtggcagctacgtttcgttgccatttcctccgcgtagccttcaaactgcgcggtttttttaatctaaaaagactcagatcgcctctgagtctttttctatcgccggatgagcggctgctatgactgccacttccgcagactattcaaattcgttttcttcagcttgatcttgctgcttgcttaacgcatcaaacgtccgcagcatctccaagttcgtctcaatactttccggccattcccaatgttgaacattaaacacatgcttgaggtgtggccccgcacttgccggccatagcttcgttgtataggtgacgtgattagcatcgaacaccttcaacaaggcttggctttgcaagtaaaagctgtcattttgcccgccaatcagcataaacggcggcaggtccaaacccttgacaacctgcgagaaattcaggtgatcggccagtgcctgatcgccgccgcttaacttgtccagataaaacgcggccatatcgctcatgtcaccggctgcttcgggaagcttacttggttctgcgactggacaaaccagcgccaccagggtgaagttgaaattaacccgactcacgccaaagagttcctgtaactccgcactctgctggatgcaggcaaccaaggacgccaggtggccgccagctgaatccccggtcaaaagcacatggtcaaggtcaaatccgcgttgagggccaaaatgcgataaccagcgcagactagcaaagatgtcttgaatctggccgcgtaaatcaacatccggtaacaaccgatagcccatacccatcactgcgtatccttgactagccaaatagcggcaataattacgattcaaattacgatcaccataaaaccacccgccaccatgaatatcgatgacggtcggcatggttgcgttgcgtcttttggccggatagtacaggttcagggtttgctgcggatcagccgactgttcgtaccgatattccgtctcccaatgaacatcttccggtacccgttcatccgcgtaccgtgccttatcccgagcagccgtttgcgcccagctcgcttgaacctttgccaacattgcctcttcatctgccattaacgaatgcctccatttcctcgtgttaacgaatcgtgttaaaaggttattcctatattaacgcaaaaagactgccggtgcgtcacccgacagtctaatcgtttgattttaagcccgttttttaacgatccttggatttaacacttgcttcaacttcatcaatcaaagcagcatcttttaacccggttacttctttaatgacgtctactaatggctgatccttgagcatcgcctgaagtttgacggcttcggcatcattaggttcaacataatggaacatcatgccaaccgtatccatcaagacgctgtaatccaaaccgcgttccttcagttcccgaatcggccggatgaagcgttcgttgtagccaagcttacgaattggcgtccgggcaactcgcgaaatatcatcggaaatatacgggttctggaaccgttgcaagacccgattttgataagtctcaagttccttttcgtcaaagtttttgaattcagctaaaagcagtgaacgggtttcggcaagcgcacctttggcctgattaaagactttaggatccttgatggcttcaccgatcgtggtgtagcccaagtacttgccagtgtaagccgtagttgcgtggccagtgttgactgagaagagcttacgttcgatgtatggttcgagatcaggaacatagtcgacggtcttaagcttcagatcatggttcttcatctggctttcgtcaacaacccattctttgaagtcttcaacactaacggctaatggatcatcatgtttttgctgcgggacaatgcgatcaaccgctgcattagggaagccaacgtacgtatcagcaaaggtcttgccggcgtcatcaagatgttcataaacgctcttcttcagcgactgtgatccgccaatcatgttctcacacgcaatcacatctaatggttggtggttgttagcggccgcgcgtgcttgcaaaccttgagcaatcagcggcgcaatgatcgggagaatcttcgggccaatcgccgtcgtaaccaagtcggcttgggcaatagctttcacaactgcctcaggatc

SEQ ID NO: 199 - DNA, 1988 bp, Lactobacillus rhamnosus
gatcttgattgtgaatcagcggcttaatcttagcttcatcaccgtaaagcaggaattctaaattggcatcatggtcgcgggctttttcaacgccggcaatcacaacttcgggggcatgatcgccgcccattgcatctactgcaattttcatggagtttatcggtcctttcgagtttaatccaaactgccttgcatcaagcgactcgcggctaagtatgccgctagcggttgatgctccggtgccagcaagtgaggatcttttgttgccaccgcttgttcattgatttccgtcagatttttggtaacaagactgtctttaggataaagatgaatgttggtcagatctgtcccgtcgtcatgccgcactggcagactcacgatcatatctgctgctttttgatacggttgcggggtcacggcttcgtgaaatgcgtacacgctatgccggccattggttttggcggccaatcctttgaatgccgccaagccgtctgcgtcagtcgtaacaattgcggcaccgggatcctgaagattcacatattgacccaggttttgcgatatcatgctcgcagcggttgtcttatcatgattttccaataattggtaaaaagcatccgtcacgttgaaaattttaaattgagcgccttgcaccggtttgcgtccggtcagtccaaggtcgtgcccggtattttgaatctgttcgtcactggtttgttcgattttgtgcagcgtgaaatccacagttgtgtcgcggcatggacggttttgcccgcactgagcagcggcagaaggaagctcatgagcatcagtgctgccaagagactgtgcccgatctttttaaacgttacttgcacgcgtggtgcctcgctttcttatttttaatgaagaagtaagtggccagtagtagtaacagactccctaaaaggacaaagcgtaaattgcgccaatcggacatagccggtaaataaccggattgacgcttaggtgtatgcgttccggtgccgttcgtatcctgcccgtgattgccaagctgggtcgttgatggccccgcggtttgatcaccggttgtcggcgcctgcttatcggcatagttataaactcgtgggtagccgctactgatcatttccggtgtcaccaccccgccaaagttttcctgcatcggctggccgtcaattaacacaaagcgccggttgccatcttcgtcttcccaagaatcaggaatctcgattttgatcgcgcggcttttagcatccacttcatagccgggaacgccttgcaattcttcaaagaaatattctccggcgggcaaaaagcgttcacctgtattaactagcccatcttgatcggaaacaaatttgttcacgcggtcatcatgcaacggatcagtagtgctcacccatttgttgcgcaagtcggttactggcgacatatcgagataaagcttcttaccattctcaattcggtaaatagcaaagatcgcaccggctaaccgtttactcgtaccatcagggtgcacgccgaacttgaagaaatacggatcgcggacataaccgacatttttcggatacagatggatggtctgtaacgggttgccactgataggatccgtgactggaaaaacaactaacatcggcgaacttttgcgctctaagtccacattgagttcggttgaaggatccggtgccacctcgatcatcagataagctttagtcggtgcctgttgatcgacagaaacggttattcggctgatcccatcttcaccgattgttggatcggtttttgtattcattagcccaatgcctttgttcccttgaccggctaatttcaggttggctcgggcaaatttcagtgcttgtttacgcgtcatattctgataacgatcaactaaagcccgaattgcttcaggcgtcatattcggtttcaataaggagctggcatcatagacctcaaagttagcgccattcagcccgctggttttgcttaataat

SEQ ID NO: 200 - DNA, 807 bp, Lactobacillus rhamnosus
tacagagtttttaacttaggaggaatttaatcatgaaaaaaggggcattgtggacatcagcagcaatcgcatcatcatttttgtgttcaacactgattcttggaacaccgacttttgcagcagaaaatagtggggcaacaatttctgctcaatcaagtttgaatgaatcacaaatgtctggtgggatgcaaaaaagtgtcttggacgctggaaataacacgacaaccactggataaaacagtatctcgacgtttgcggctaacgattacactttgaaaaactttacgataggcgattcatcggttccgcgtaatgacgttgttgatgtttctgattggcaaagctggatgacacaaaatgactatacccaattacataatttggggattaaaggggtcgttgttaaagtcactgaaggaacctattacacaaatggtattgcggcaaatcaaattaagtttgcgcgaaatgctggcatggtcgtttctgcatatcattatgcaacctttgattcggccagtgctgccgttgcagaagctaactattttgctaatcgacttgattcacttaatgtcggtaaaaatgtaacggttgttgctgatattgaatctgacgctgttagtggagacattgctgggaacttgaaagccttttggcagacaatgacccagcgcggttaccagaatcatgttgcctatacaatgcgttattacaaacatttggacgctttgacttcaacaactggcaaggatcgcacttggattgcgcagtatccgtatacaccaagcgcaaactcgctatgggatc

SEQ ID NO: 201 - DNA, 381 bp, Lactobacillus rhamnosus
tcggatagctggtttcgcaagttggctgatctgggtgtcaaggcggtggtcgtcaaactgacagaaggaacgacttaccagaatcctaaggcggcggcacagttggcggctgggcgcaggatggggatgcaggtgcacgcttatcactatgcccattttcataacagtgccgaagccgttgcagaaggacgtttcttcggcgtcacggcccgcgcgctgggcgtgtcgacgcaaagtgtgatggcagcggatgttgaagcgcctgatttgactggggagctgacggggttgacgaatgttttcattcagacggtcaaagcgctagggtatccgcacacagacctgtacacaatggcgaattggatgaaaaccagacgcttt

SEQ ID NO: 202 - DNA, 1156 bp, Lactobacillus rhamnosus
gtttacgtagcagtcgggttagctttgtttatttgaaggccacagaaggcagcagctattttgacgataattttaataccaactttactcaggcagcagggagtcgaatgagcataggcgtgtatcacgtttttagcttcgaaacgacaccgcaagctcaagcaactcaatttatccgcaaagtaggctcaaacattggcgacctgcccattggtatttacctaagttattatcgcgagcaaaagccgagttccgcgtggttgacacagcatctaaccgagtttatcacgctcgttcaacaacgctatcatcgccaagttttgctgatgggtagtcctgatattttaacggcggtcaaaacagtggttccaaaagcaccgcggtggacgatcacggacaagcggcctgctaacaacggcggcttttggcaatatactgacggtgcgcggttgccagacggtcctcaggcatcctatcgagcagcggtattcatgggcaagcgcagcacatttttgaagctggctcaatagtcggaccaccattaattcgtgcaaaaagctgagcattgcactgatctaacaaaaatgttcgttgaatgttcgccgaaactatccacttaattgaacaattgggacatactgataagcgaggtgaacagataatgaaaaaagtcctgatcggcttggttgtgctgattgtgctcgtttttggcggtttgaaaatttttgaaattaccaactatggcggaaccacgtactacacgaaaattaccaacactggtcagcgggtgacggatcgcgatgatgaaggcaacaagtcatcatttatgcctatgatttgcctggatatgatgagaaaggcggtctgcagcagttgaagtttaatgcgaaccaagatcgacccgctgagaaaaaatgcttatctaaaagtaacttacaatgataaaaaaggggtcaccagctgggaaagtgtgccgcgttcggaagttcccaaagcggccttgtcaaaacttgaataaagcaatcaaatgcatcactttctataacgcgctccccggcgtaggagtctgcgtgtaaggaccttggatgtaatgaccaagagcgggtcatcacgtccaaggccgtgagttctcctttacgcccataacgcgttcgct

SEQ ID NO: 203 - DNA, 1753 bp, Lactobacillus rhamnosus
agtaaagttgtcgctggacaaagcgttgaatacacaccgaaccaatactattggaagggcaagccgagtctttcaaagattacatttgaaaatgtttcatctgcttcaatcacctcagctttaaagaaccacaagtatgatatcgtttatggcatgccttccgacagttatagtgactggaagaacattagtggttacacgaatctgggtcatcaaagccttgcttataattaccttggtttcaaactcggtaaatgggatgataagaagagcgaaaacgtttatgatccaaattcgaagatggccaacaagagtcttcgtcaggcaatgggctatgcgttgaacaacgatcaagtcgcggccaagttctataacggtacgcggtctcgtgcaacgacattgatcccacctgtttttggtaaagatgttcacgctgatatcgatggctatgatttgaacattgacaaggctaatagcttgctggataaagcaggttataagaagggcaaagatggctatcgaaccgatcctaaaggcaagaagttaacgatttactttgcaaccatggctggcggttcaacggcgcaaccattggcacaggattatatccagcagtggaagaagatcggtctgcgcgtcaagctgacaaccggtcgtccaatcgagtttaattccttctatgacaaggttcaaaatgattccaagggtattgatgtttatgctgctgcttggagcctctcttctgatccttcaccaatggacttgttctcacagaaagcaccgtttaactacactcggttcgtttctgctaaaaacaccaagttgctgaatgatattgatagtcaaaaagcaatggatcctgcctaccgtgctaaggctttgaaggcatggcagaaatatgctaacgatgaagcatttgtcatccctacgctttatcgtcaggaaatcttccctgttaataaacgtgtgaagaatgcgagtgttgactatgcttcagcgaagtacctgaactggagtaaaatgacggttacaagtaatagccgtgcaacaaagtaattcggtttaaaagttaaaccattaaggcatctgcaatcgcaggtgtcttttttggtgcgctctagtataattagatagtgcgataaaaaggagggctcttcatggttgcctcagagtttgtgagcgaattgcgtcaacgctatgggattgagtttcatgatctcagcttactggatgaagcattcacgcattcttcgtatgtcaatgaacataaagaattaggactaaaagataacgaacgacttgaatttttaggtgatgccgtgctcgaattaacggtttcagactatttgtaccgtaaatttccggataaaccggaaggcgatttgacccgaattcgggcagcggcagtgcaaaccgcggcattttctgctttttcgaaagaagctcattttgatcgttatattaaattaggtaaaggcgaggaaaaagccggtgcccgacaacggttgacgctgcttgaagatttgtttgaagctttcaatggtgccttgtacctcgatcaaggacgagaagctaatattaagtttgccaagcggattatttttcctaaaatcgatgcgggtgagttttcggccgatcaggatcataaaacggccttgcaggagaccttgcagcaaaatggtgatgtcgcgattgtttatcacctgttagacgaaaaaggacccgcgcatgagcgtcaatttcacgttgatgt

SEQ ID NO: 204 - DNA, 625 bp, Lactobacillus rhamnosus
  misc_feature (1)...(625): n = A,T,C or G
ctcattgcccaccattatnacgtggtgncagtgataacgcagccggatcgtaaagtcggccgtnagcagaaactggccgcaagcccggtcaagcaagcagccgtcgctcataacattccggttttacagccagaaaagcttagcggcagtcctgagctggcgcaggcgattgccttagcgccggatcttattgtgacagcagcgtacgggcaatttttgccgaccaaatttttacaagcagccaaaattgntgctgtgaatgtccatggttcgttgctaccgaagtatcgcggtggcgcaccgattcagtacagcattatcaacggggatgctgaaaccggcgtcaccattatcgaaatggttaagaagatggatgctggcgatatgtttgcgcaggcgaagttgccgttaacccgccaagacgatactggcactgtgtttgcgaaattatctttattgggtcgtgatttgttattgcaaccttccgaagattattgaccaaaccgccacccgtacgccacaggatcccgagaaagtcacgtttgccccgaccatcaccaaagagcaggagcaccttgatattcacttgtcggcgcaagcattggatcaatgggtccgcggcttg

SEQ ID NO: 205 - DNA, 1058 bp, Lactobacillus rhamnosus
  misc_feature (1)...(1058): n = A,T,C or G
gagcgtgtcggctgcatggaaaagtcggcacgctcaccggtgatacgatgatgagtatagaacatggcgcttacaatagaggaggaaaccacctgtgattccgcgttatagtcgtcctgaaatggcggcaatttggtcagaaaaaaatcgttatgctgcatggctggaagttgaaattttagcggctgaagcttcaacaccaggctggttgaatgggtgatcccgttcaggtagccggagatggaaactgccgcttcaaagaagtagatcagatagcctaaggtgtaggcatcttgtttcggaatggaaatggtcataactgggacgccgccatctgtgtgggccagaacaacgccttcgtaagctttgcggttaacgaaggacatcttcttgccagccaagtagccgaggccatcgaggttttgagcgtcgtcaggaatggttaggtcgcggttaggttcttcaacccacacaacggtttccatcagattgcggaggccttcttgaatgtattggccgagactgtgcaggtcagtactgaagttagcgcttgaaggatagatacccttttgatctttaccttcagattcgcccattaattgcttccaccattcgncaaggtattgcaaggttggttcgtaattttcgagcagttcggtggtgtagcctttgcgatataaaatgttacgcaaagctgcatactgataggcttcgttttctttcaaatcagctgatgcataggcttttcgaccatcaccgagaccgcgcatcatttcgtcaatgtcgccgccagcaactgcgattggcaataagccaactgctgacatcactgagaagcggccgcaacgtcatcaggaaccacgaattcttcgtagccttccgcatcggcttcttgcttcaaagcacccttggcccgatcnttacaggcgggccagcaagtggcaagtgacacaattgaagctaagttaaagaatagcgacttgcatgcaagcattaaggtcgatgtcggcagattgcctgaggtgcttgatgattttgaatcttgaattagtaactgg

SEQ ID NO: 206 - DNA, 424 bp, Lactobacillus rhamnosus
  misc_feature (1)...(424): n = A,T,C or G
gatcctgagctaaaattcccagaagtctattttgcgggtaactcaatctccggtacttatttagctgatttgctcgacattatcggcgatcgtgacttctcgatcaacgtcntcagcaagtccggtaccacgactgagccttccattgctttccgtattttgaaggctaagttaatcgaaaagtatggtaaagatggtgccaaggaacgaatttatgcgacaaccgatcgggccaagggtgctttgaagcaagaagccgatgcggaaggctacgaagaattcgtggttcctgatgacgttggcggccgcttctcagtgatgtcagcagttggcttattgccaatcgcagttgctggcggcgacattgacgaaatgatgcgcggtctcggtgatggtcgaaaagcctatgcatcagctgatttga

SEQ ID NO: 207 - DNA, 555 bp, Lactobacillus rhamnosus
htgatcttcgtgcccccatggataaaaggcgcggttgtccggatccttgccaccggttaatcctgcctcgtcgccataataaagacaaggtacccccggcagccaataaagaagtgacacaatcaactgtaacttacgccgatcaccattcaacacggtcaagattcgcgccgtatcatgcgtaccaatgttgttaaaattaaacgcaaacgcattgggcgggtaattttccttgagcgtcattaactgacggacaaaaccggccgcgctgagttgaccgttgacaaaatcaatcaacatcgaccgcaaagggtaattcatcacggcgttaagctcgccaccttcaaaatactggcggcgtttgccataagcctgcttattcgatgcatcttcccaaacctcgccgatcaaaacccggtcaggaaactgatccaatgtcgtccgaatttgatgaataaagtcgtcagtcagctcatcggcgacatccaaacgccagccatccacgcccagatcggtccaataactgatcaccgaatcttttttacggcaataaaa

SEQ ID NO: 208 - DNA, 672 bp, Lactobacillus rhamnosus
gcaggtcgacactagtggatctcagcttgtttgaggcgcaggatgcttcacaaatcgttgcggatgcagctaaagatgatgtcaatattatctttgggacttccatcaatgaagagctcggagatgaagtggtggtaaccgtgatcgccactggtatcgaagaagaagaccaacgccgcgaaacaacgcgccggccagccgctgccaatcgtaacactgatcaccgaatcttttttaacggcaataaaattgtgaaaatcctgattgtctttattaatcgccgggaggtctttaaccccccaccagctgttatagtcatcaggaaatcttttaaacgaaaaccacgatgcgtacggcgaatccagactgttcgccgcgccaacatcgtcatattcattcacggcattgaaataccggctgtcggcaccgacatgattgaacacaccatccagaatcacgtgcatccccagctgatgagccgccgccagaaactgcttgaagtcatgcaatgtacctaacacttcatcaatcgcataataatcaccggtatcatagcggtgattgctgcgcgcctgaaaaatcggactcagataaagcgcattaatcccccgtgcagctaatagcggcaatttttgctgaatgccggttaagttacctccgtaaaagtcccag

SEQ ID NO: 209 - DNA, 595 bp, Lactobacillus rhamnosus
gacactagtggatccaatgtcgtccgaatttgatgaataaagtcgtcagtcagctcatcggcgacatccaaacgccagccatccacgcccagatcgaaacccctccaactgccatcagtggtaattttccaagtggtgcctgaatagctttaaagaatcctgacccgactgtcgttgccggaaagactttgacaatatctgcacctttttcaaacatcgtatgaacttcagtcggtgtcatagcagccggcacggtgatgactccatgctgtttggcataggcaaaaatgtcgtccgtaaactcaattggacttagcataaatttcgcacctttagctatagcgtcttgagcctcggtcagcgttgtcaccgtcccggcgccgatcttgattcggtccccgtactgcgcattaccttcttcgataatgtccagtgcatgcggcgtattcatcgcacttcaacaccaaattgattttcaaacccagccatcgcctgcataatggcatcagcctgttcaggcgtataaccgcgcataataactgtaaaagtcggatactctgataactccataatcttcctcctgagcgtgagccgg

SEQ ID NO: 210 - DNA, 687 bp, Lactobacillus rhamnosus
atcccgggcgcgaggattattacggcggtgatttacaaggggtactggaccaccttgacgatttacaagcgcttggtatcaatgggctgtatttttgcccgattttcacggctgcttccaatcacaagtacgatacgattgattatttgaacgtggaccccgcgtttggcgataaagttttgttcgcgaaattgattcaggcggctcaccaacgcgggatgcgagtcatgcttgacgcggtgttcaatcatatgggctttggcagtatgcagtggcaagatgttttacgcaacggagaagcatcgcggtttgcgtcttggtttcacatctatcaaacaccagtcacaccgtttcacaatcctctcaagaatgccggccaaccgcagtatgatacctttgcatttgaagaaaagatgcctaaattgaacactgccaatcctgaagttcaagaatatttattaacagttgccacttactggatcaagacatttgatattgatgcgtggcggttagatgttgccaatgaagtcgatcatcatttctggaaaaggttttacgccacggtaaccgcgattaagccggacttttatgtgttaggtgaagtctggcatcgcgcgcagccatggttaaacggggatgaattttccggggtcatgaactatcccttcacgcagcagattgaggatc

SEQ ID NO: 211 - DNA, 1082 bp, Lactobacillus rhamnosus
  misc_feature (1)...(1082): n = A,T,C or G
gatccccgttggcaaagcgttctggaaaaatctggtnccaaactgtctgtttaacccaatcaggcgttttaacccgatcaatcgcatgaaaatacggcatccgaaaatagttttccgccttatgtcgtgctgccgcgtgattttctcggacgccgcgatcaccatacaaccacacagcgccatcttggccggtaacttcaaataaatattgcaggcggcgataaggagcttcgagtgtcacctcccagtgatccctagtttgcccgtgacctatcaaatgcatcgaccggcgctgataaatcaacttattagtgccatctgcatcaggcagttgccaataaggatcgccatacagaaccgtcaccttcgcaacatcggcacgtgccgtgtgaaatcgcacacgcattgcctcatccgtatataagaaacaatcttcactttccgggcgatgcaacaaagcagctaagttcataatccgcccttctttcttcataagtaacaaaatcctgccaaaaaacggtatctatacagcgatcataccgccttcatatcaggcgctcaaacaattcgcatcagcgtgtttgccctccgcttaactgaatatcgtttaatgtcatttaggctacaatcataacagtctattggcggttcatcattagggcatcatacaaggcgtcagggcccgatgcgtcagagcccgatgaccttgatcattgaatggggctgccacgctcaggacaaaataaataggcatcagcgtcatctctgaccgctaatgcctatttgtgttacaccaacactcatctgccaaaaagccttcatgctagcgtaaattttattaataccgcgcttttaatgcccgctgaacctcacgctcttgatccttacgctttaaggtttcgcgcttatcatagttgtgcttaccttccgcaacgccgatcaacactttggcataaccatgtttaagatacatccgcaacggaaccaaagtaactccttggcgcgccgtcatttgaccgagcttgcgaatttcttttttatgcagcaacagtttacggttacgcatcggatcnacgttaaac

SEQ ID NO: 212 - DNA, 1628 bp, Lactobacillus rhamnosus
ctgcagacaaaacgacgcaacctgtcaaccaagctcagacgcagacggcaacatcaacggcaagcagtcaaactgccactgctgatgccaaggataagacagctgagacacaaccaacaaccaccactacgactaagcaagtaaccgcacagtcgcaggccgcaccatcgacagctaccaaggctcaatcacaggcaagcacaacgaaccagacgcaaccagcagcagcaactaaagttcaaaccggtacgccgtcatctggtgccaacacgcaaccagctgctaacaccgccacaaccaaaagcgcaacatccacggcatcatctgctgcaacgcaatcggccgcaccggctagcaatgctgcaaccacgaacgccgccaagacccaatctacggccgcaaccacaaccgatccaggaccggccaaccaagacactttgactaaaggtaacgtcaagggtttatggaatgaaggctatcaaggccagggaatggttgttgcggtcattgattcaggggttcaggctcacgacgacttacgcctcagtgatgacagcaccgccgccatcaccaaagaaaaagccgaagctgccatttccaagttaggctatggctcgtacgtcaacagtaagattccatttgcttacgattacgtcaataacgacagcgtcaacaccgggaccacggtggctggctctacccacggcgaacacgttgccggtatcatcgcggctaacggcacgaccgctgacggcgcaaccggcaatgaaaaagccaccacttacgtaaaaggggtggctcctgaagcacaaattcttgcgatgcaggtcatcgatgaattcgcggatgaaaatgctaatgatatttcgcgcgcaattcgtgatgccgtaacgctcggtgccaacgccattcaaatgtcactaggcatcggcgttaccgagcaggatctcactgacgaagaacaagcagccgtgcagtatgccactgatcacggtgttttcgtctccatctctgctgggaataacgccaacgcaggcagcattatcggttccaaaacgtccaatgatatctccacggcttactcgccaaaaaatgattcaactatcggcgatccaggcgcagcggcttccgcaatgacggttgctgctgaaaagagtgcaaccggtgacaaatcagaaatggacggcttttcatcatgggggccaatggcggactacaccttgaaaccggatatttccgcgcctggtgataacgtcatttccacggcgattgatccaacgaccaatacccaaacctatgccactgaatcaggaacttccatggctggtccttacaatgccggcgcggctttgcttgtgatgcaaaaaatcaaagcaacccggcctgacctgcaaggagccgaccttgtcaaagcagtcaaactcgcgctcatgaatgccgccgatccaatgaaggatatcaattatcctgatacttacatctctcctcgacgtcaaggagctggccaaatcgacgtttccaaagccggcgatctaaccgttagcgctgaaggcaacaaagacgccggttcggtttcgctaggtaaaattggtcaaaccacaagcttcactgtgacactcaccaaccat

SEQ ID NO: 213 - DNA, 1301 bp, Lactobacillus rhamnosus
ccattaagtttaatgcctagcttcttacacagattgatgttatctcgcgtgcgatagagagtatcgaccagcacctcatccggatattcacccactaggtcaaaagcatggtcaagcgttacttcaagatcaaagatgttgacctcgtggtgattttggggaacttactcgataacgccattgaagcaatcagtgaacagccgcccgacgaaaagcggcagttgcggctttacatcggcatcgttaaacagcaattttacatctcggtcaccaacacccggccggccgatcggccacaccagcaaccaggttatcacttaaatccgttgcaaacaaagtggtcaagtcatcttctgctaccgtgtcggcatcaatataaatcgctttgtcatactgtggaaacatatccgcgataaacaagcgaaaataaatggtcagggtcacgtaatcaccgcgcagtttgttcgtatcaccgctgatttgtcgcgtgaccttatccatcgcgataaagcgaatgtcaaaattggatgtccccaaagcagccaaccgcttttgattggcgggtaataagccattattaagaatattgatttcaaaattgacacgtggatttttatttgcccgaatcgaagtcaaagcaacggccagacaaggaacgtagccatcatcgacggaaaagaaaattggaaccgtggttggagttggcatttaggacacttctttcaatttaggtgctagccggcgataatctttcagcaaatcatcatattcatgcaatcccagctgctgatgaacggcatgaatctgccacggcttgaccgtcacaatgcgaaaacgcggccaaaagcgaaacgatgtcgtaaagtgctgaaaaaccgtatccggctcaagcttatgctgctcattgtattttggcggcagaatccgtttacacttggccagcttatttaaagcactctgatccggcataaacagccaccgttgctgtaacaactggcggcagcgcgctaataaaccatctgcgcgaattctagcaagattcatcagcaaaacgccggaattgagataatcaaaccacatcaaccggtgatgaaaccaccatttgccgtagtggtccaacgcaccggcaatatcaacaccagtcatggactcatggtaaaacgcagcaaacggccgccgacaaatgacatcggtatccagataaagcatacgatcaggtgaagctcattttgaatgctaagacgacggtagctaaacgcaacgagttgcatatgttcacggtgttaccgcaacgatggatc

SEQ ID NO: 214 - protein, 227 aa, Lactobacillus rhamnosus
MSTHIDAPKGAIADVVLLPGDPLRAQYIAEHFLEKAVRYNTVRNAFGYTGTFEGRRISVQATGMGIPSISIYVNELIQDYGVKTLIRVGTAGGMGSDVKVRDVILVQGSSTDSSIVLNTFGAGMYFAPIADFQLLREAANLADAGALRYHVGNVLGEDRFYNDEMDRQKLIDYGVLATEMETPALYLLAAKFHAQALSILTVSNHLITGEETTAQERQTSFNDMILK

SEQ ID NO: 215 - protein, 371 aa, Lactobacillus rhamnosus
MIDVVTSPATIGIIGGGQLGRMLTQSAKTMGYRVGILEPTPNSPAGQVADFQITAPYDDQAALTKLAKESDVLTYEFENVDLAALEAVRDLTRIPQGTAILATTRDRIKEKTFLQTHGVPVTPFAAVDRPEALTAAIEKIGLPSILKTTTGGYDGHGQQDINTMADVPAAEQLLAHGPCILEKRQQFDREASVMITRDGRDQVRVFPIVENRHKNHVLHLTLAPAPNISPVLAEKIDDLATKITLGLDLRGVLGVELFLEGDNVVANELAPRPHNSGHYSIEACNFSQFDAHILSICGLPIPQITLKQPAVMRNLLGDDLTQAKAKWPQHPEWHMHDYGKAEIRPGRKMGHITVTDARDVMDILKQMEAAW

SEQ ID NO: 216 - protein, 484 aa, Lactobacillus rhamnosus
MFVADTKKQLRWYNVALIAFVSVWGLGNVFNNYAQQGLSVVTSWILIMLIYFVPYALIVGQLGSTFKDQAGGVSSWIKETGSVRLAYYAAWTYWVVHIPYLAQKPQAILIALSWLFKGNGDFVNTVSSMTVSLICLALFLLFLWLSSRGLTTLNRIGSMAGTAMFLMSILFIILAVTAPLMVKGVHVATPNMGDIHTYLPKFDLNYFTTISMLVFAVGGAEKISPYVNNTKHASKEFPLGMLVLAGMVAFCALLGSFGMGMLFNSHHIPTDLMANGPYTAFAMLGKYYHVGGLFVILYSIANALASISALAFSIDAPLKILLSDADPHFIPKKLRRINRKGTPINGYWMTGILVSLLIIIPAFGIGNMNELYKWLLNLNSVVMPLRYLWVFLAYYLLNQHLEKFQADYMLVKNKRLGMLVGRWCFFFTAFACLLGMLPKISYLNDPGTWWFQMGLNIITPVILLALGLILPVIARLHENDLDAQ

SEQ ID NO: 217 - protein, 272 aa, Lactobacillus rhamnosus
MQELEKYSLDDTYIRPFDREKQEIALETKDLHVFYGDNEAIHGVSLPFERYKITALIGSSGSGKSTYLRSLNRMNDNIESARVTGKIMYRNIDINSDAVDVYEMRKHIGMVFQRPNPFAKSIYDNIAFALRRFGIKEKKKLDEIVETSLKQAALWDQVKDDLNQSGMSLSGGQAQRLCIARAIAMKPDILLLDEPASALDPISTSAVEDTLLSLKDKYTIIIVTHNMQQAARISDYTAFFYSGAALEYDETRKIFTRPKIKATNDYVSGHFG

SEQ ID NO: 218 - protein, 254 aa, Lactobacillus rhamnosus
MAEAQKIITSSDVHLFYGKFEALKGINLDFNEHEITALIGPSGCGKSTYLRTLNRMNDLIPGVTITGTISLRGQNIYAPSEDVVQLRKQVGMVFQQPNPFPFSIYENVIYGLRLAGVKDKSILDEAVETSLKQAAIWDEVKDHLHDSALSLSGGQQQRVCIARVLAVKPDVVLLDEPTSALDPISSTQIENMLLELRDQYTIILVTHSMHQASRISDKTAFFLTGNLIEFADTKQMFLNPKEKETEDYITGRFG

SEQ ID NO: 219 - protein, 300 aa, Lactobacillus rhamnosus
MLKKSRSSKLERRGKTISLICISLIVLVVVAIFFFVASKGLATFFQNKINLWSFLSKSVWNPSIKDAHGNPEVGALPMIVGSFGVTFLSAIVATPFAVGAGIFMTEISHKWGQKVLQPVIELLVGIPSVVYGFIGLSVIVPFIRHIFGGTGFGILAGTFVLFVMILPTVTSMTVDALKAVPRHYREASLALGATRWQTTYRVVLRAAIPGILTGIVFGMARAFGEALAVQMVIGNAALLPKNLVSPASTLTSVLTSGIGNTVMGSLENNALWSLALLLLLMSLAFNLLIRWIGKKGELNK

SEQ ID NO: 220 - protein, 234 aa, Lactobacillus rhamnosus
MKKILIVDDEPAILTLLQYNLEAEHYQVETATDGQEALDKVRSEPFDFIILDLMLPSLSGLDVTCKIREEKIQTPIMILTAKDNETDKIVGLELGADDYVTKPFSPREIIARIKAIERRSQSQPQAPLSRNANQITVGQITIDPENYKASKAGHRLQLTPKEFELLVYFAQRVGKTLSRDALLNGVWGFDYPAETRMVDIQVSHLRDKIETDPKHPDYLKTVRGFGYQMEAPHE

SEQ ID NO: 221 - protein, 250 aa, Lactobacillus rhamnosus
  VARIANT (1)...(250): Xaa = Any Amino Acid
MLLSGFLVKMALLTNSWNLSELVHNSCXILNLLDYHLSKEGFSTQLVTNGRKALALAETEPFDFILLDIMLPQLDGMEVCKRLRAKGVKTPIMMVSAKSDEFDKVLALELGADDYLTKPFSPRELLARVKAVLRRTKGEQEGDDSDNIADDSWLFGTLKVYPERHEVYKANKLLSLTPKEFELLLYLMKHPNMTLTRERLLERIWGYDFGQETRLVDVHIGKLREKIEDNPKAPQFIRTIRGYGYKFKEL

SEQ ID NO: 222 - protein, 269 aa, Lactobacillus rhamnosus
MQSTYGTRFLRVFVKNSRFNFGTMDSDVTVPNDCRVNGVKIMKILIVDDDKEIVELLSIYVKNEGYEPIQAYSGKEAITKLVTNPDIALMILDIMMPNMSGMDVVKEVRKDSQIPIIIVSAKTADMDKIQGLITGADDYVTKPFNPLEVMARVKSLLRRSQNEVTNSEPDVLEVGPLTIKKDSHEVTTLTGKQIQLTALEFGILYLLASHPNRVFSADEIFERVWQQESIVSAKTVMVHVSHLRDKIEEATDGEKVIETVWGVGYKVEA

SEQ ID NO: 223 - protein, 224 aa, Lactobacillus rhamnosus
VFKIMIVEDDQTISGLIADNLKKWQFEPVVVTDFNAVFDDFLQEKPHLVLLDINLPVFDGYYWVQKIREVSKVPVIFISSRNTNMDMVMAMNMGADDFLNKPFAMEVLIAKINALLRRTYNYADQGTDVLEHNGLMLNLKNGMAQIGEKEINLSKNEYKLLQILMRQHGQIVSRSRLLRDLWQDERFVDDNTLTVNVNRLRKKIEEAGLKDYIQTKVGQGYIVP

SEQ ID NO: 224 - protein, 246 aa, Lactobacillus rhamnosus
MNHNRYKCGANRLGAMEGEGMQTKVLAVDDDAAILAMLKRYFAWRLPEFRLLTADAGQAALSQLAQQPDLILLDVNLPDIDGFTLTSRIRAITSVPIIFLTARITDQDKVQGLGAGGDDYVTKPFSLTELGARIKAHVRRAHQPDKQAQIAVFGRIMIDYHAHQVSVDTTCLKLENKQYQLIEWLSLNPGQVFSREQLYEKIWGYDAQGDERVITEHIRRIRKLFDACQVTSPIVTVWGVGYKWQN

SEQ ID NO: 225 - protein, 258 aa, Lactobacillus rhamnosus
MTNMSGISILFSKQRPIDPQRKTRLTRTKKERLTLVKILVVEDDRNFNDLIATILRQNGYTVQGAENPPAAYDLLQSEQFDLVLSDIMMPQVDGYQFAQELRRTDPSIPILFITARDDIASKEKGFNSGIDDYMVKPINFNELLLRIKALLRRAKITADNLLIVGNLTLNNEAITAQVNHQTVDVTVREFQILYKLLSYPDHAFSRAELINEFWDLASDTSMRAVDVYITKLREKFKAADGFTIKTIHGLGYKAVLTL

SEQ ID NO: 226 - protein, 422 aa, Lactobacillus rhamnosus
MKKQAIRMARGDYSGQVRVYGQDELGQLAVAVNNLSVRVEEAQEASEAERRRLDSVLAHMTDGVIATDRRGNVIIINQTALSFLNTKNEDVIGVSILKLLNIAKDYTLRDLLEHQTELLLDFSEQLDHDLILRVDFSLIQRETGFISGLVAVLHDVTEQQKIDRDRKEFVSNVSHELRTPLTSVRSYIEALSDGAWKDSKLAPQFLNVTQEETDRMIRMINDLLSLSRLDSGTSKFNLETVNLNEFFNYVLDRFDMMLKTDNEHTGEARTAQPLPQPDGQKKRYSIKREITHEDLWVEIDTDKFMQVIDNIMNNAIKYSPDGGVITARLFQMHDHVILSISDQGLGIPRQDLGKIFDRFYRVDKARSRKQGGTGLGLAISKEVVEALHGRIWVDSQEGRGSTFYISLPYEPITDGGDDWDEA

SEQ ID NO: 227 - protein, 422 aa, Lactobacillus rhamnosus
MALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 228 - protein, 675 aa, Lactobacillus rhamnosus
MQVLSRVWQSIRWFFRRFQVIRWLILLGLTVILIFSAWFTYKAKTADVQNIKSTLQTKTVIYDANNEEAGTLYGQKGTYVELSAISPQVQNAVISTEDRTFYSNGGFSIKGILRSALNYVIHHGQIMGGGSTITQQLAKNTLLTQKQTMLRKAQELFMAIQLNKVYSKQDILAMYLNNAYFGNGVWGVQDAAKRYFGKNASQLDASEGAILAGMLRNPSYYNPADHKDNAISRRNVVLQLMVDNHKLTQAQANAAKAQSVQVVDAFSNANAQKYPSYFDSVIEEARSEGISVDDILNKGYKIYTNLDQTYQQNLQTSFEQDWAFPANAADGKQVQGASIILDPKTGGVRAVVGNRGEHTFLGFNYATQLRNSPGSTIKPLMVYTPALENGYHYDSILKDEKLSYGKNNYTPTNATGTYLGTVPMYQALADSINAPAVWLLNKLGVQKGVASLDRFGIQLKSSDQNLAAALGGLKNGVSPLMLARAYAAFANDGKLPTTHFIRKIVDASGETVVDNSHPATRQIMSKKVAQEMTSMMIGTFNEGTGKTAKPSGYTIAGKTGSTEVPSSWGYGTKDQWVVGYTPDIVNATWIGYPTTDSQHFLQGTSTSGVAPLFKLEMSKLMPNTPQTAFDTKDAAQMASIQTPGKSDDTWQGIPYSIDRGIVSAKQSVAQWYDTI

SEQ ID NO: 229 - protein, 771 aa, Lactobacillus rhamnosus
MYVANNQNMSRMARRREGKQSKSPKPPKKLWRRILKWTLLGLLLIFIAGVGLFSWYAKDAPEVTQAKLESGGSSTIYDRSGNEITTLGLENRDYVKASEIPQQLKDAVVSIEDRRFYDEKLGIDPVRILGAAFNNMTGTGDGLQGGSTLTQQLIKLSVFSTKSSDQTLRRKAQEAWLAMQVQQKYSKDQILEYYINKVFMNYGQYGMSTGAKFYFNKSLKDLSLAQTAFIAGLPQSPAGYDPYEYPQKATQRRNAVIDAMLRDKKITAAAAKQAKATPITDGLQPKQQQTNTTTNDKVIDSYLTQVIAEVKKKTGLNPYTDNLDIYTNIDMSAQKRLYDIVNTDDYVSFPDDAFQTGVTMTDPDNGQVLAQIGGRKTGDVRLAYNRAAQNTRSNGSTMKPLMDYGPAIEYLNYSTYEQMTDEPYKYPGTTISLYDWDKKYQGRISMRTALEQSRNIPAVKTLSAVGMTNAVKFLKGLGIDLPASEQYLSSAIGASVNTVEEAGAYGAFANGGTYYKPYYVNKVVSADGNTQTFNSQGTRAMKSSTAYMITDMLKGVLTKGTGTSAAISGLYQAGKTGTTDYSDEELKQNPALNATGIAKDAWFTGYTRNRVISVWTGYDKPTSHGISYAEQTISQKIYKALMSYTSQNLDNKDWTKPDTVESYNILKGSNPGTAITSGSANTTKELYVRGHGPSSHKAVAESSSSSSASSESSSSKESSSESSNAVSASIASHATSSSVSSTAPSSAAPSKEETSSSSEPVSSAGGPGGNQ

SEQ ID NO: 230 - protein, 660 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSDQAGTAHDLAIDGHTIAAKTGTGAELKQKQDTDGKENGFLVAMDADKNTYLTVALIEGTGSGDVVTGNEAFCG

SEQ ID NO: 231 - protein, 306 aa, Lactobacillus rhamnosus
VGTQERGERLSSLAEFFTALGKYDFLQSALITAIMVGIMSGLIGSFIILRGMSLMGDAISHAVLPGVAVAYMLGVNVMIGASVFGIIAALLIGFVAANSKIKTDTSIGVVFSAFYALGFILISMAESATNLHHILFGNILAVSDSDIMTTAVVLGIVILFVVLFYKELLITSFDNTFAKTYGLNTTAIHYALMLVLTLVTVSALQTVGIILVVAMLITPAATAFLWTDRLETMLVMAASVGVISSITGLYFSFTFNWASGPAIVLVAAVLFAISFVFSPKQAFFSFSKRQRTKTAATTQTAEEVIR

SEQ ID NO: 232 - protein, 458 aa, Lactobacillus rhamnosus
MDPKKLATTEYYQHRFRNFSTMIIMPSTILFLGLLLFLIFARREVTVLTAAEIEPVKAAVTVQATAANRIVSNRMKEGKRVKKGETLLVYHDVANPTQIKLLKQQLATLKEQQQQLDVLKQSVTENKDLFSKADRFGYQQQVQDYLSQRRVLTLTAEAEQATQTVASEKNKEIDRLLSASIQTSQAKMAAISEAKAAIQANKPLPSRHAYHYLYQQYESEIKNTDAEAQANLKRQYLAQLQTQLDEEQTNLTSLEQQRAGQKQADVSAQKAGETQANLTALQSRLQQTAVAEQTKVQQQVQADEAKLATLNDETQNYHVKASASGVLHLETALAGNQYVPSGSVLARILPDLTEQTVADIKLGVSPTEIMSIKRGQKVRLRIAENVPTPTILDGRVYAIDVAPTRDPKVGNFFTVKARVKLSKSQRQSLYYGLAGQASVITGTKTYWDYFADKMFNHR

SEQ ID NO: 233 - protein, 340 aa, Lactobacillus rhamnosus
MTVKIGINGFGRIGRLAFRRIYEIGAKSNDIQVVAINDLTSPTMLAHLLKYDSTHGTFPGEVSATDNGIVVDGKEYRVYAEPQAQNIPWVKNDGVDYVLECTGFYTSAEKSQAHLDAGAKRVLISAPAGKIKTIVYNVNDDTLNADDKIVSAGSCTTNCLAPMAYFLNQEFGIEVGTMTTVHAYTSTQMLLDGPVRGGNLRAARSAAANTIPHSTGAAKAIGLVIPELNGKLQGHAQRVSVVDGSLTELVSILKTKNVTADQVNEAIKKHTENNPSFGWNEDEIVSSDVIGTTYGSIFDPTQTEVTTAGDYQLVKTVAWYDNEYGFTCQMIRTLLKFATL

SEQ ID NO: 234 - protein, 88 aa, Lactobacillus rhamnosus
MEKREFNIIAETGIHARPATLLVQAASKFNSDINLEYKGKSVNLKSIMGVMSLGVGQGADVTISAEGADEADAIAAITDTMKKEGLAE

SEQ ID NO: 235 - protein, 101 aa, Lactobacillus rhamnosus
MKINHPGTAGTLESSDIQITLAPAADGITIQLQSSVEKQFGEQIRAVIKATLAKLAIENVAVEANDKGALDCTIKARTIAAAYRAADNKTFDWEEINAWIN

SEQ ID NO: 236 - protein, 292 aa, Lactobacillus rhamnosus
MDKLRRTMMFVPGANPGMLRDAPIYGADAIMFDLEDAVSLKEKDTARMLVYSALKTFDYSSVETVVRVNALDAGGDQDVEAMVLGGINVIRLPKTETAQDIMDVDAVITAVEAKYGIKNGTTHMMAAIESAEGVLNAREIAQASPRMIGIALGAEDYLTSQHTHRSADGAELSFARNFILHAAREAGISAIDTVYTQVDNEEGLRHETELIKQLGFDGKSVINPRQIPVINSVFAPALAEVQKAREIVAGLKEAEAKGAGVVSVNGQMVDKPVVERAQYTIALAKASGMEVD

SEQ ID NO: 237 - protein, 510 aa, Lactobacillus rhamnosus
MVKNKLNREIPEPFADQYGVFGGEFANIQPYDEHARHIKPVKPDHSKLVASIHDAIVATGLKDGMTISFHHHFREGDYVMNMVLAEIAKMGIKNLSIAPSSIANVHEPLIEHIKNGVVTNITSSGLRDKVGAAISSGIMQNPVVIRSHGGRARAIARGDIHIDVAFLGAPSSDEYGNINGTKGKATCGSLGYAMIDAKYADQVVAITDSLMPYPNTPISIPQTDVDYVVQVDAIGDPTGIAKGATRFTKNPKELKIAEYAAEVITKSAYFKDGFSFQTGTGGSSLAVARFLREAMLQQNIKASFALGGITNSMVELLKEGLVEKVIDVQDFDHPSAVSLGENADHYEIDANMYASPLSKGAVINQLDIAILSALEIDTDFNVNVITGSDGVIRGASGGHSDTSAACKMSMVIAPLVRGRIPTIVENVNTVVTPGASVDVVVTEVGVAINPARPDLIEMFKDLKVPQFSIEALKNMAYQITGTPAAIQYGDKVVALIEYRDGTLIDVVHNV

SEQ ID NO: 238 - protein, 304 aa, Lactobacillus rhamnosus
VFILARTIGIIGIGHVGVTTAFNLVSKGIADRLVLIDQKADLAEGESYDLKDALGGLPTYTEIIVNDYDALKDADVVISAVGNIGAISNGDRIGETQTSKQALDDVAPKLKASGFHGVLLDITNPCDAVTSYWQYLLDLPKSQIIGTGTSLDTYRMRRAVAESLNVNVADVRGYNMGEHGESQFTAWSTVRVNNEPITDYAQVDYDQLADAARAGGWKIYQAKHYTSYGIATIATEMTQAIISDAKRIFPCANYDPEFGIAIGHPATIGKLGVVNTPKLKLTDEERAKYVHSAGIIKATVEKMK

SEQ ID NO: 239 - protein, 397 aa, Lactobacillus rhamnosus
MIHMAKKDFNQLALDQAKVNGGKLSVEPKVPIETRDDLSIAYTPGVGAVSSAIAKDQSLVYDLTTKKNTVAVVSDGSAVLGLGNIGAEAAMPVMEGKAALFKRFAKVDAVPIVLDTQDTEAIIAAVKAIAPTFGGINLEDISAPRCFEIEARLIDELNIPVFHDDQHGTAIVVLAALYNALKVADKKIEDIRVVVNGMAGGSAGLSVARRFLAAGVKHVMVVDKVGILAKKNADQLPPHHAAIAKITNRENRTGTLEDALKGADVFVGVSAPHVLNPAWIKTMAPKPIIFAMANPEPEIFPDEALAAGAYIVGTGRSDFANQINNVLAFPGIFRGALDARARKITIDMQIAAAKGIASLIPDDELSTTNIIANAFDGDVAEVVAESVRNAAKATAKA

SEQ ID NO: 240 - protein, 407 aa, Lactobacillus rhamnosus
  VARIANT (1)...(407): Xaa = Any Amino Acid
VGQIILAGAMQQLPVNMLGGFAVILTMGWLLGTIGANIPVVKNFGGPAILSLLVPSILVFYNALNPNVLKATDMLMKQANFLYFYIACLVCGSILGMNRKILIQGLMRMIIPMMLGMILAMGVGTLVGVLLGLEWKHTLFFIVTPVLAGGIGEGILPLSLGYSTITGTTSGALVAQLIPATIIGNFFAIMCSGLLNRLGEKRPELSGAGTVGSTEWGRRXTWQTRKTIRGPLDLKMMGAGVFTACTLFIIGMLLQSVPGFPGPVLMIVAAAILKYVNVIPGETHRGAKQLYKFISSNFTFPLMAGLGLLYIPLKDVVGMLSWQYFIVVISVVLTVVSTGFFVARFLNINPVETAIVTACQSGMGGTGDVAILSTANRMNLMPFAQVATRLGGAITVITMTAILRMIF

SEQ ID NO: 241 - protein, 317 aa, Lactobacillus rhamnosus
MTSGGDQVNIGIFTDSYFPQVSGVATSIKTLKDDLERKGHQVYIFTTTDPHVPDDAVEPNLFRFTSVPFVSFTDRRIAVRGLFHAYAVAKELNLDIVHTQTEFSMGYIGKFVAKQLKIPTIHTYHTMYEDYLHYVLNGHLLKPYHVKQFTRAFLYHVSGVIAPSERVYDTLRRYGVKTDIKIIPTGVDLTQFAEQKDPHLREKLGLADVPVLVSLSRVAYEKRIDKLISAMPAILAQIPKAVLLIVGDGPAREDLEAQAAELGIADHVRFTGEIDHDDVGDYYRVGDVFVSASDSESQGLTYIEAMAADRKSCCPCW

SEQ ID NO: 242 - protein, 560 aa, Lactobacillus rhamnosus
MHKSWWQEAVVYQVYPRSFQDSNGDGIGDLQGIIQHLDYIKELGADVIWLNPIYKSPNADNGYDIADYQQIMPEFGTMTDFQQLLKAAHARGLKMMMDLVVNHTSDEHPWFQAAKQSRTDPHHDWYIWRDPVDGHEPTNWRADFGGSAWTYVPEVGQYYLHLFAVKQPDLNWTNPAVRKAVFDMMTWWCDQRIDGFRMDVINLISKPDVFADDPHLLEQPNGNSLGLIANGPHVHEYLRAMNKAVLSKHDLMTVGEAPGVTPALALQYTGFDRHELEMVFQFKHVGLDNDPQFGKWSLKHPQLTDLKRVLSDWQTALHGKAWNSLYWDNHDQARAVSRFGDDRPAFRVHSAKMLAATLHFLEGTPYIYQGEELGMTNVAFPSIHDYRDLDTLNAWHELVEQQHALAPEDMLKRIHRRSRDNARTPMQWSPAPQAGFTAGTPWLAVNPNYTDINATAALADSDSVFFFYQKLIRLRKQYPDLIVYGAYTLLDPDDPDVYMYQRHAAKQELLVISNFTDQTLTRDIAKQLSPSAKLLISNYDDDAENTLRPYETKAYLTSER

SEQ ID NO: 243 - protein, 319 aa, Lactobacillus rhamnosus
MALISLEHVTKTYDDKPVVNDLSLQVDQGELFVLVGTSGSGKTTTLKMINRLVDPTAGVIKFAGKPLMAYKVRDLRWNLGYVLQQIALFPTMTVAQNIAVIPEMKGWSRQKIRTATDDLLAMVDLPPAEYRDRMPSELSGGQQQRIGILRALASRPKVVLMDEPFSALDPISRTQLQDMLLHLHRAMKTTVVFVTHDMAEAMKLGNRIGVMHNGRLLQVDTPEAIATQPANDFVADLFKGAQANQGLQVTLSQLAPFAVEQSADHAVGGNLTLAEALPLLDAHETLRVKSDHGVFVIDTHSVVAYLASAFVDQDTETKG

SEQ ID NO: 244 - protein, 379 aa, Lactobacillus rhamnosus
  VARIANT (1)...(379): Xaa = Any Amino Acid
MTQFNTKLVHGPQLNVDQAGAIVPPVYQSAMFRFAPDGQETHWDYARSGNPTREYLERQIATLENGDAGFAFSSGVAAIATVLAIFPDHSHFIIGDSLYSGTDRLINQYFSQHGLTFTPVDTRDLAAVEAAIRPETKAIFFETFSNPLLKVSSVKAISALAKTHDLLTIVDNTFLTPYYQRPLDLGXADIVLHSATKYLGGHGXDLIAGLVVSAHPDLSEKLAFLQNTIGAILSPLDCSLVTRGIATLSVRLIVKLQTPKPSPNFXAQHPDVAHVYYPGLKNDPGYALAQKETTGASGLLTIKLADNIDPLKFVNSTKIFDFADSLGTVSSLVKLPWFKLPEDKRADFGLTPQHVRIAIGLEDQQDLIDDLQQALVAAE

SEQ ID NO: 245 - protein, 307 aa, Lactobacillus rhamnosus
MKKRQTVKNIGEVINNLRERKGMSQADLSTGILSKAQLSKFERNLTQISATKLLALLERLHVTFAEFGNALAFQEALYEQSILADITKAVVNNNRDQAELVRERAAEHFTAFPGKYNQLILIMVNAMIADMTGETLSQADIDVLTDYLFHVDGWTRFELLLFGNTISALPLRTVNQLARELAAQVNVAWEIHQNFQLIINLLYNVVIVNLSARDLTTARHYLRVMKDSHVEDGMMAERFLIALAEALCIYCEDGTAAHKDQVEKIIAIQKELGATNFFIAFKNQAEMFINETKQTDAFPAGWQSYIF

SEQ ID NO: 246 - protein, 259 aa, Lactobacillus rhamnosus
MSWSIKKVFNRHKEDQETQKNGVMLVAFAEPKHVVSEQFRTVRTNIEFAGAALDKCQVVMFTSSAMSEGKSTVSANVAVTWAQAGKKVLLIDADLRRPTVHATFRKLNLDGVTTILTGKNKPEEVVEDTFVDNLSMISSGPVPPNPSELLNSKRMGELLEWARSNFDIIVLDAPPVLAVSDVQVLVPKTDGVVVVANIGKTLKGDLRRTVKVLKLAQAKILGSVDGVKAKHGDRGYGYGYGYGLRLPEPEVRKSSFYRT

SEQ ID NO: 247 - protein, 331 aa, Lactobacillus rhamnosus
MLMSDMPLVSIIVPIYNVEKYLQRCIDSLFAQTYVNIEIVLVDDGSADRSLSICKKNAQQDERVRVFSKTNGGVADTRNFGVSVARGQWISFVDPDDYVDPDYIEYLYGILVKSNATMSICQHRNVYKNGKIQTNLYEGPAVLDSHTAVKRLLYDDQIDTSVWAKLYPAWVFKKIHFPKGRLFEDIAATYKTFLASDSIAVGSEAKYSYPFRYNSIVNDQFSLHKLDLIDMTEQMACEVKKVYPDLQIASQRRVLYAYISTLNQMQNVDGYQEIREQLISKIKELRKPVLEDHKAPIRDKVAICLIGFSYPIYRKAWKIYLKIKKGEEVSA

SEQ ID NO: 248 - protein, 479 aa, Lactobacillus rhamnosus
MKWIITKIVKNLLWNMGYQIFILLLPIVTIPYVSRVLGPTGIGINAFTNSIVQYFVLFGTLGLTMYGNREVAYQRDNPKRLSGLFWELTLLRLVTTGIATLLYLGFILLSGEYQVFYLIQGLLLVATAIDVSWLFQGLEEFRITVLRNTLVKIISLILIFVLVRTKNDLWLYILILTGSQVLGNLTLVPYLKKYVVVPHWYDLKVIDHLRPTIEMFVPQIATQVYLQVNKTMLGALVGVQASGFYDNSDKIVKILLAVVTATGTVLLPHTAHSFAQGKHDEVEASLNKSMHFILVIAFPMTTGLAGIAPIFTKIFFGKGFDPVANLLVIESIVIVLIGISNATGVQYLLPTNQLRPFTTSVVFGAVANMVLNVPFILIWGSNGAMIATVLSELLVSIYQLSKVRNQLRIRSLFSEVWKYLVAALLMGVSVRVFINVLPLSNFLALLGATMYGALIYTLALVILRPKILLQMISSLRGLR

SEQ ID NO: 249 - protein, 632 aa, Lactobacillus rhamnosus
MTLPRIQDDLYLAVNGEWQAKTPIPPDKSVVSADSNLTDDIRQKLVADLSTMTKTAKTLPLQYAARLFAKANDQTRRQQLGIEPVRDRISFLMALTTLDQFRSAMPKLVADQYVLPISPYVDADMHDAEHNILNLGGPDTILPDAAMYQHEDAENAADLAAWSQMAAAMLAAVGFSQTDQTAYVEAAKRFDRRLADYVPANVDLAVDSTYDNPLSWQAFEDAAGYLGIPQAFATYMPQTPAKVNAVVPAYLPHLSKLLTPDNYSEWHAWMVINELLTCATYLSDDLRQLAGQYDRFLAGQPEASSWTKHAFGIANEYFDDVIGQYYGQTYFGADAKADVTAMVKQILAQYRVQLENNTWLSPATKQKAMRKLATMQVKMGYPERLFSLYDHLSVDVDDDLLTAILKLSAQTQAFWFKQLGQTVDRNQWNMPGHLVNASYDPLKNDITFPAGILQPPYYSLKWTRAENLGGTGATIGHEISHSFDNNGALYDEYGNLHNWWTPADKQAFDQLVKAMAAQFDGRDYEGVKVNGTLTVSENMADNAGMDVALALLGDQPDVKDLQAFFITYARSWATKMRPERAKTVLRQDVHAPATLRVNVPVQNFPAWYQAFNVQPQDGMYRQPQKRLTIWHQ

SEQ ID NO: 250 - protein, 341 aa, Lactobacillus rhamnosus
MVELQSVKDESPLSRALQDEHYNGAVAVVSPDKELAADSQGFSHIDMAVPFASHTVSGAGTVTQQFFGILLMQFVEKGVVKLSDKLSQYVPEYHNADQITLHQLANMQSGIPDYLTLMAKPFKENAPATLPDERLALQIDQHNATNMDFAKVLDVVNDVPLAFKPGSQTSYSSTNAILIGEVLDRLTNERPLEAVLKEYIYDPLALTNTKLGTAHAFAEGYHWIAGNPNIAGKGDENQADRGLVTTVDDLEKFAQAVLTGKLLQSTSWKTIFKDAENGYGFGWHKLENGWLGNSGSMLGYTGLLSINQKQKKAVVGLTNVLKPQPAMDQFFNTIYQVATTL

SEQ ID NO: 251 - protein, 709 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSDHPIDIQVLGIGRNGHIGFNEPGSPFDAETRKVPLTQSTIDANARFFENENDVPRYAYSMGIGSIMKSKKILLLAFGENKADAVQKMIEGPVTNDVPASILQKHPDVVVILDKAAASKLSHK

SEQ ID NO: 252 - protein, 502 aa, Lactobacillus rhamnosus
LKFKELGLDHDLLKAIAQSGFEEATPIQAETIPLVLEGKDVIGQAQTGTGKTAAFGLPILQHIDKADRSIQALVISPTRELAIQTQEELYRLGRDKKIKVQAVYGGADIRRQIRQLADHPQIVVGTPGRILDHIGRHTLKLEHLDTLVLDEADEMLDMGFIDDIEKIVEQMPTERQTLLFSATMPAAIMRLTNKFMKEPVIVKIKAKELTADTVEQYYVRAKDYEKFDVMTRLFDVQDPDLALIFGRTKRRVDELTRGLKARGYRAEGIHGDLTQQKRMSVLRQFKSGQLDFLVATDVAARGLDISGVTHVYNLDIPQDPDSYVHRIGRTGRAGHKGVSVTFVTPNEIEYLHTIEDLTKKRMLPMKPPTAEEALMGQISSGLATIKEQVEANDTEKYEAMAETLLENYTPLQLVSAYLKAVSPDDASAVPVKITPERPLPRRGRNNHGHGNNRGGYKGGYKGKRRDGGYQGNRDGKRSYDKKRNFGDKRKNVKRNFKIRTGE

SEQ ID NO: 253 - protein, 64 aa, Lactobacillus rhamnosus
TDVAATSEADVVFHNGLNLETGGNGWFKKLVKTSHKEFDKDVFAASKGVTAQHLTTNTKEQDPL

SEQ ID NO: 254 - protein, 312 aa, Lactobacillus rhamnosus
DNMTTLIFGHQNPDTDAITSAMSWAEFQKQAGNTDVEAVALGEPNDETKFVLDHFKVAAPRVIKTAANETGHVMLVDHNEFQQSVADIEDVQIDSVVDHHRIANFHTASPLYYRAEPVGSTNTVIFELFQEHGYEISPTLAGLMASGLISDTLLLKSPTATDKDKKILPEMAKIAGIDLQSYGLAMLKAGTNLAAKSDMDIIEGDAKSFTMGGKSIRIGQVNTVDLDDIYARQDELVAAMTKEAQAKGYDDFLLIATDILNSNSAGFAVGADRDKVAAAFNEKFDANDRLALPGVVSRKKQVVPPMQGAFEG

SEQ ID NO: 255 - protein, 161 aa, Lactobacillus rhamnosus
KGAVIKIIDKIEKTSVSGTKTWRDNNNQDGIRPSSITVNSLANGQQVASKKVTASDNWQYSFDNLAAYANGQKITYTVTEDAVAGYTSTVDGYNITNTHNPTTPKKPQVPNNPTTPKEPQVPNNGNKVTPKDFTQGKMYDKTSRLPQTGDGSSMGMMLIGL

SEQ ID NO: 256 - protein, 101 aa, Lactobacillus rhamnosus
MKQILTWLVRGYQRFISPLFPPSCRYYPTCSTYMIQALQRHGAVKGFLMGIARILRCNPFVKGGLDPVPAYFTLRRNPHPENDLDLSDIQNLNRKLGGHHG

SEQ ID NO: 257 - protein, 98 aa, Lactobacillus rhamnosus
RIPDHTAVKAPYVRLITTEKGPNGDEISNYDLRLVQPNTAAIDTAGLHTIEHLLASLLRDRMDGVIDCSPFGCRTGFHFDYLGNTQHHGSRQSAEVQP

SEQ ID NO: 258 - protein, 214 aa, Lactobacillus rhamnosus
VRLLAKKRRRFTLKKVPLAAWLVIAFFAVGSMLVVSSYWSQRQAEVSQRQAIVDKKAAEKAKKEAFIKRLVPTAQAMQKQYGVLTSITLAQAILESDWGTSTLAKDYHNLFGIKGTDPATTKVLRTKEYVNDKWITVDGRFRVYSDDAASIRDHALLFVNGTDWNPQQYATVRAAKDYKTAASALQTDGYATDPDYPQKLIHLIEAWNLTQYDN

SEQ ID NO: 259 - protein, 276 aa, Lactobacillus rhamnosus
MTKVKKERVDVLLVEQGLFESREQAKRSVMAGEVYDQNNQRLDKPGVKIPGDAILHVKGKKMPYVSRGGLKLAKALKVFAIDLTGKTVLDIGASTGGFTDVALQNGAKMSYALDVGYNQLAWKLREDPRVKVMERVNFRYSKPEDFTDGPVEFAMTDVSFISLKLILPPLKAILMPHGHAVALIKPQFEAGPAHVGKHGIVRDPQVHRDVLKMIVNFASATGYNVLGLAYSPIKGGEGNIEFLIHLQNADQTPGEIAPTVDIERTLSDAYAALKRP

SEQ ID NO: 260 - protein, 375 aa, Lactobacillus rhamnosus
TFAGFFASASAATTLADKVAPIFGSWSFAHEAAVILVTLILSYFSLVFGELYPKQVALQMTERVAKISVTPISWLATLMRPFVWLLSASTKLLMKLTPMEFSHEGESVTREEMVAMIENGRNAGAIEPDEYQMFEGIISLSDTMAREVMVPRTDAFMIDAKEPDQSAIDAILNNIYSRIPVYEEDKDHVIGIVHIKNLLKEARRVGFEQVKIESVMTEPVFVPETIPVDVLLTEMQTKQQQMAILLDEYGGVVGIVTIEDLLEEIVGDIDDESDQAEKLYTKQTDHDFIVSGRMPISEFNELFKTNLDAPDVDTIAGYVLTQLGAIPSTHHSERLELAPGVQLATGKVEGSRLVNVHIHLSETPPLEVVSKEADS

SEQ ID NO: 261 - protein, 150 aa, Lactobacillus rhamnosus
MRVSKSSHYEFNNEMFSAITHAFALGLAVTGTIALGIKGVNSGSQVELFSLIGFGVSLMLLYTASTAFHGFYFSKARHVLQVLDHSGVFILIAGSYLPYCLVAIGGKLGIGLLIAIWALCLGGIAYKLFFLNRFKHLETMIYVVLGWLCL

SEQ ID NO: 262 - protein, 771 aa, Lactobacillus rhamnosus; identical to SEQ ID NO: 229

SEQ ID NO: 263 - protein, 384 aa, Lactobacillus rhamnosus
NKNGDKPDYVTNKAKTAKILSRYLAIGEDKVLARLNPSKNLFQVEFGRPGTKLSLAIKKQIEAEKLPGIHFRETPSRLYPNGVFASHVIGLAQAQDNGGGLTGVMGLEKQFNTVLTGTNGYRRSETDAYGYKLPNAKTKAKAPVNGGSVYTTLDSGLQAYLETLMTDVQTKYEPKGMTAVLMNAKTGRILAATQRPTFDASTGEGLGDMWRDSLVEDNYEPGSVMKIMTLAAAIQSGKYHPNEYFQSGSVKLDGGTVNDWRTGGWGSIPLSKAFPLSSNVGMVKIEQEMGAGIWKSYLDKFKFGQKTGITLPGETSGRISFQRPLDQAITAFGQGIEVNVMQMMQAISAVANDGKMLKPQIVSKVVNKNGKATVYKPEVVGQPI

SEQ ID NO: 264 - protein, 588 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSD

SEQ ID NO: 265 - protein, 149 aa, Lactobacillus rhamnosus
GMGSQTGGSTLTQQVVKMMFLNSETTFKRKAAEIMLARRLNNHFSKNTILATYLNVATLGRNNKGQNIAGVEAAAQGLFGVSAKEVNLPEAAFIAGLPQSPFVYTPYTADGKLKTSLKAGINRQQTVLFRMYRAGVISHRQYVAAKSFD

SEQ ID NO: 266 - protein, 134 aa, Lactobacillus rhamnosus
SCKAEAAQKAVTAVASSTASASSTSASSSTTASSNSLGSSKAASSQAPASAGSSTVSVSGGSIAGNAAKYLGVPYVYGGTSPAGFDCSGLIYYAAKEAGISLPRTSQAQSTLGSYVSVSDLSFLMRRFSEVIRR

SEQ ID NO: 267 - protein, 503 aa, Lactobacillus rhamnosus
MPWIIAAVLLILLFIFLATHRKTALPNEVLIISGALISGKHSFRDVNGNRVKLITNGGSFILPILQRWDVLSLNTRTIEVATPEVYTQQGVPIIVNGTVILKIGSSQEEVATAAEQFLGKNDEQINSEATEILEGHLRAILGTLTVEDTYQNRDAFAEKVQDVASSDLAKMGLQIISFTIKDIADKNGYLDSLGKKQIAEVKKNAAVAEAAANRDTRIQQAQADQEAKQQEIERQTQIADAEREQQVKMADFKKQQEIAQAQADQAAIVEQMKAKQVQKEKDIELAQKNAELQEQELNATVRKQADADLYKAQRAAEAQKATQIAAAEASAKEVELDAEAKANATKAIGEAEAGKTKAIGLAQAEAIAKQAEAARQLDESGRFKMTIEAMPKIIEAAMSPYANVDSIKLYGDGDLTNQTSGSLVKQLDMLQEVAGIDIRGMLNGALMHQAGNQPVVDAIKHHEQPAAKAPDTKQPAPAPKSDQPATTEQAASSTPSRMAEKQK

SEQ ID NO: 268 - protein, 240 aa, Lactobacillus rhamnosus
MTKKASGTSRLLRWFVILLFTAGAACFCYPFAATAINELLLTSRRAAAQQEAKQNAAAQDEQRAAENRALAQTGLRPGQDPFQSRQKFNQAYVKRHLIGRVVIPKLAVDLPLFDTTNNTLLDQGAVVLPGTSYPRGGKSTHTVISAHGGLPTKRFFTDLSKLKRGQKFFLQVNGKKMAYQVFRIKTVRPDETQSLRIEPGRDLATLMTCTPYMINSHRLLVTGKRVPYTEALEHAAESAD

SEQ ID NO: 269 - protein, 270 aa, Lactobacillus rhamnosus
MLKKKLWFLLPLVALVTFTLTACTSASSDTSKNSDVTAELINKNELTIGLEGTYAPFSYRKDGKLEGFEVELGKALAKKIGVKAKFVPTQWDSLIAGLGSQKFDLVLNDISETPARKKVYNFTTPYMYSRYALITRSDNTTIKSLADIKGKTFVEGTGTPNAALAKKYGAKITPSGDFTVSLSLVKEKRADGTINASAAWYAFAKNNSTAGLKSQTLKDSVVKPDEVAGMVSKKSPKLQAALSKGIQELRKDGTLKKLSQKYFGTDLTTK

SEQ ID NO: 270 - protein, 108 aa, Lactobacillus rhamnosus
MRLQEKVAKRIHELRLSKSMTQEQLAEKANMDVSMLARIERGSRGDIRMSTLERIVSGLDVSYQEFFTFPEDGDETTELASSIALIKDPEVIRALHKIVNTLIHRDNK

SEQ ID NO: 271 - protein, 414 aa, Lactobacillus rhamnosus
ILLALLFGVGAATTSVMANTQYMTVKAESVNVRLGPGLAYGIMGQVKSGNELTIIGSKNSWYQVRLAGNKIGWVASWLVDQSEAATTSAKVATVNQPVNVREYASQDAKQLGTLNAGDSVKVVYQEGDWTQIAYNNTAAWITSSSVQLTGQTTNLAQPAQANLTQAKSGAALKVTTNTITNLRNAAGINAPSVEKLDKGTELTVTKQQDDWYQVTAPDGKSGYVASWTVTAPNNGQTQKAATKLSEATIVLDPGHGGTDTGAPANNNHDYEKTYTLKTAELVANALRAAGANVIMTRTTDTFVDLAPRPTTANNAHADAFISFHFDSSPSKNSASGFTTYYYSSKKDLALAKAVNNAFDDLPLENRGVAFGNYEVLRDNKQPAILNEMGYINNDKDFKYIKNPTYQSKIADGYC

SEQ ID NO: 272 - protein, 488 aa, Lactobacillus rhamnosus
QLRKDLKHKMKTVPIKYYDTHSNGDIMSRAINDMDNIASTLQQSLTQMVTSAVMFVGTIWMMLTISWKLTLIALVTIPLGLIVVGIVAPKSQRFFAAQQKALGLLNNQVEETYGGQVIIKSFNREDDEVEAFEGQNQAFYDAAWKAQFVSGIIMPLMIFLNNIGYVFVAIMGGIEVSNGTITLGNVQAFLQYMQQFSQPISQLANLANTIQSTIASAERIFAVLDEEDMQDEPSGVPAVANDPNKLVMDHVQFGYTPDALLLKDYNLQVKPGEMVAIVGPTGAGKTTIINLLERFYDISGGSIRLNGTDTRDMKREDVRAHFAMVLQDTWLFTGTIWDNLKYGREDATDDEVLAAAKAAHVDNFVRQLPDGYNTILNEEASNISQGQRQLLTIARAFVADPEILILDEATSSVDTRTEIHIQHAMNRLLTDRTSFVVAHRLSTIRDADKIIVMNHGSIVETGNHDELMAKNGFYADLYNSQFSGNVAI

SEQ ID NO: 273 - protein, 445 aa, Lactobacillus rhamnosus
KLNGAAGSVLNINGGNLTLTDDGVSAGTLTGGGFLNISGGVLDITGGNHTFAVSTIIAKDATVRMNDVSGLGTGNISNAGTLSLTHASGLLSNNLSGSGTVSLINSDTQISGNNSNYSGLFVVDTSSQLTATGAQNLGIASVSNRGILQLNNTTDWQLINNVTGTGNVRKTGSGSLTVRSNAAWSGQTDIDDGSLILGQSDAPVMLASSLVNIAKNGKLTGFGGVVGNVTNSGSLDLRSAAPGNILTIGGNYTGNNGTLLINTVLDDSSSATDKLVIKGDASGKTRVAVTNVGGSGANTLNSIEVIHVDGNAANAEFIQAGRIAAGAYDYTLGRGPGSNYGNWYLSSSKNTPEPRPDPEPTPEGHDNNLRPEASSYTANIAAANTMFVTRLHERLGQTQYVDAITGEPKATSMWMRHEGGHNRWRDGSGQLKTQSNRYVIQLGGD

SEQ ID NO: 274 - protein, 393 aa, Lactobacillus rhamnosus
MLEKKFYHTMFSHSFNIPVRVEYWDHTEETYGTGEPTITIKMKKAIPVRLLLKNASLALGEAYMRGDIEVLGGKRPLQQLIAAAYANADSFMRNNKLMRVLPKQSHTERKSKQDIHSHYDLGNDFYKLWLDPTLTYSCAYFENWDDDLETAQLNKIDHILRKLNPQPGRTLLDIGCGWGTLMLRAAKTYHLHVVGITLSKEQFKLVSDRIEAEHLNDVAEILYMDYRELDREPFDYITSVGMFEHVGKENLEEYFKDVAKLLKDDGVALIHGITRQQGGAVNAWINKYIFPDGYVPGMTENLAHIVDAGMQLDDLEPLRRHYQRTLEIWDTNFNNHRNPIQQKFGYEFTRMWDVYLQAAAASFEAGNIDVMQYLISKGPSGKDLPATRDYMYE

SEQ ID NO: 275 - protein, 103 aa, Lactobacillus rhamnosus
KYSYFRANEDYAEIARYLGLPGKTTDELVESYVQAFIKLAHSVGIKLSLKDQGVQKADLDKQVDRLAELAYEDNCTVTNPQEPLISDLKHIILDEYEGTDSTF

SEQ ID NO: 276 - protein, 456 aa, Lactobacillus rhamnosus
ISWHRLRPPDRMYVEKYIASAKHVEVQVLGDEHGHLLHLFERDCSVQRRQQKVVEIAPAVALPLALRNRICQSAVDLMASLHYENAGTVEFLVDGDQYYFIEVNPRVQVEHTITELITGVDIVQSQLRIAAGADLFADLHLPQQDALRENGAAIQCRITTEDPENNFMPDTGTINTYRSPGGFGIRLDVGNAYAGAVVSPYFDSLLVKASVHAPSFPAAVAKMQRALHEFQITGVKTNVAFLEHLLATQTFRTGEAETAFIDAHPELLQVQAKPDIASRLLWYISDVTVNGFKGVERQSQKYYPELQYTRHFAAAKPQTDLVALLKNEGAQAVTDWVKAHPALLLTDTTFRDAHQSLFATRMRTRDMLTVAEDMGNGLPNLFSMEVWGGATFDVAYRFLNEDPWVRLKKLRAALPHTLLQMLFRGSNAVGYQNYPDNVIKAFINQAANDGVDVFRI

SEQ ID NO: 277 - protein, 383 aa, Lactobacillus rhamnosus
MKEAELIAIRRQLHQIPELALQEKETHAFLLKTIQSFPQTFLTIRTLPKLPTAILVKVTGSDPQRTIGYRADMDALPVTEATGLPFASHHPGIAHACGHDMHMTVALGVLSYFSIHQPKDHLIFFFQPAEESKNGGKLACDMGAFTGEWQIDEFYGLHDRPDLPAGTISTRLGTLFAGTTEINVDLIGKSGHAALPQNANDMIVAAASFISQIQTVVARNVGPTDSAVITFGLMRAGTIRNVIAGSAHLEGTLRGFTQKQINFLQQRIRDIGQGIAASFNCEVKVDLNQGGYYPVENNPHLTKDFIDFMQADPAVTFVPTDPVMTGEDFGYLLNKIPGTMFWLGVNDPDSQLHAADFSPDEAALAPGVTAIIHFLTHRMAEAA

SEQ ID NO: 278 - protein, 267 aa, Lactobacillus rhamnosus
ATTVASAENTDVITQAVTITDASGLKLGPETVQLSSNDFVDSFDQKKFYVVKDASGKLSTGDAGDYTADAKGKIAIVKRGSLTFTDKQKYAEAAGAAGLIIVNNDGTSTPLTSISLTATFPTFGLSNTTGQKLVDWVTAHPNDSLGVKIALALLPNQNYKADRMSSFTSYGPVSDLSFKPDITAPGGNIWSTQNNNGYTNMSGTSMASPFIAGSQALLKQALNNKDNEFYADYKQLKGTALTDFLKTVEMNTAKPINDINYDNVIVS

SEQ ID NO: 279 - protein, 248 aa, Lactobacillus rhamnosus
MHPLFGYLTAWSNIFQFVVVGMSEMIAIGEYFKFWWPELPAWLPGLVAITFLVLANLISVRMFGELEFWFALIKVVTIVLMIIAGLGVILFGLGNGGRPVGISNLWTHGGFFTGGFTGFCFALSIVLGSYQGVELLGITAGEAENPQPTIVKAVKDTIGRILIFYVGAIFVIVAVYPWNQLSALGSPFVQTFAKIGITFAASLINFVVITAALSGSNSGIYSASRMLYTLADAKQLPRIFTKLNRHGV

SEQ ID NO: 280 - protein, 114 aa, Lactobacillus rhamnosus
IIIGTTIVIPGIVMHFFCGGIAAIFGNATGGRKGALIGPFIGGIILSFLPLVATGLYGGLGYTATYWSDSDFNTIGVLLGLVAKVGKWPIMLAALIIFAFPFVFSALHKKKLVD

SEQ ID NO: 281 - protein, 440 aa, Lactobacillus rhamnosus
MLRTLKNALKVKDIRNKILFTLAVLLVYRLGTLIAVPGVNAKALQSIGSTGLISLLDTVSGGGLAQYSIFSMGVSPYITAQIVVQLLQMDIVPKFVEWSKQGEVGRRKLNQVTRYLTIAFGFFQAIGITAGFQTLSSMGLVKNPSVSTYITIGIILTGGTMLLTWMGEQITDKGLGNGVSLLIFSGIVARLPSGLQELYRDNVQVYSGSEIWKGIAFLAALAVIVILVITFVTWVQQANYKIPIQYTRRVTSAGSNSYLPLKVNVAGVIPVIFASSFIVTPQTILMAFQKNHGTDGWYQVMTNVFNMQKPAGTAIYTLLIILFTFFYAFVQVNPEKVAENLTKQGSYIPGVWPGKETENYISRLLMRLSTVGALFLGLVALLPQLAANIWGLPQSIGLGGTSLLIVVMTAIELVRQLDGLLMKREYVGFIRGDLVKNDKK

SEQ ID NO: 282 - protein, 173 aa, Lactobacillus rhamnosus
MPRGILGSLLIAVFLFVSVGLVLLGMFPYQDYANNAEPVGWALRHSGHAVVATVVESIAVLGMFTALIGMAMAGSRLLYSFGRDGMLPHGLGKLNSRKLPNRALAVLITIGVIIGAFFPFAFLAQLISAGTLIAFMFVTLGIYRLRPREGQDIAKPRFRMPFYPVLPAVAFLG

SEQ ID NO: 283 - protein, 220 aa, Lactobacillus rhamnosus
IAQSPQAKKAGLKLKVKQVADGNVTNSATAEGQLDVNAFQSYAYFEQYNKANPSQKLAALGTTYLEPMGLYSKKYKRLSQLPDGATIGISNDPANATRGLLLLAAAKLITLKPDFNALSTVKDIQSNPKHLKFKEVDPSVQVLPDLDAGLISNTRALDGGLNVLKDSLVHEKLSQDTRANVNILVTAVKNKNKLELKKLVTLYHNSTIQAWIKKTFSGTK

SEQ ID NO: 284 - protein, 98 aa, Lactobacillus rhamnosus
IAGIFILGTNGESYVLAEDEKLAFVEHVIDYVHGRTKVLVGTGLNGTAETIRFSQKVASLKPDAITLVAPSFVAPSQQELVDHGWEESNQYVGCDGSQ

SEQ ID NO: 285 - protein, 240 aa, Lactobacillus rhamnosus
LSQYMVTDNDKMEADLDDPYILITDKKISNIQDILPLLQEIVQQGKALLIIADDVAGEALPTLVLNKIRGTFNVVAVKAPGFGDRRKAQLEDIATLTGGTVISSDLGLDLKDTKIEQLGRAGKVTVTKDDTTIVDGAGSKDAIAERVNIIKKQIADTTSDFDREKLQERLAKLAGGVAVVKVGAATETELKERKYRIEDALNATRAAVEEGYVAGGGTALVDVLPAVAALKEDGDVQTGI

SEQ ID NO: 286 - protein, 497 aa, Lactobacillus rhamnosus
LDPSKASEGVSGQAIIDTMNGLYKYYGHKLQPAMATKIVKPTNNGLTYTFTLRDAKWSDGTPVTAQDFVFAWQRTVNPATKSSQANMYSGIKNADDIRAGKKPAATLGVKAINSKTLEVTLEHPIPYFNSLLNNVAFFPQPAKKVQEWGNKYGTKSEYTLSNGAFKSKGWTGTGDKWTEVKNNRYWNQKNVHLTQIDVQVVKDTNTALDLYHTGKLDDATLTGPTCRTTKVRPVMSPPNAPARIFLELNENKVPAFKNTKIRQAISMAINRDSFVKNVLADGSIVARGITPADLSQLPDSSTDFATAVGKGTKTITTYNKKKAQTLWNQGLKELGIKNVNVELLGDDVDAVKATQEYLQGTLQENLPGLKISIASVPAKNRQQRASTRDFDMVLSTWGADYPDPNTYLDLFTSTSEYNHGQWQNSDYDQLMAKANGADANNPTARFKDMTQAEQLLVNQAGAIPLYQLVAARMVNPKMHDLKTSPGNSFNFVYAYLK

SEQ ID NO: 287 - protein, 121 aa, Lactobacillus rhamnosus
VKNISDYRNKKVLVLGLAKSGVNAARLLHKLGALVTVNDKKQFDDNKEAQELLADGMRVITGRHPVELLDEHFELMVKNPGIPYSNPMVQRAQELGLPIITEPELAFQVSEAEWIGITGTN

SEQ ID NO: 288 - protein, 267 aa, Lactobacillus rhamnosus
IVFLAYLGYSIWNIWRYIHNQRLKWPHFGLSLDTSRLPFHLPQAVTVFGIAFFALMTAVSEMNRPQLLTRTFDRNYIVKYLGLAPFTIYDAAKTAQNNQVRAQADSANLDPVLQYTRSHYAAPNASYYGAAKGKNVIIIHLESFQQFLIGQKIDGQEVTPFLNSLIKEKDTLSFNNFFHQVGLGKTSDAENMLETSTFGIANGSLFSSLGTENTFEGAPAILNQRAGYTSAVFHGGSASFWNRDNVYKSLGYNNYFSGNFYNHDEKA

SEQ ID NO: 289 - protein, 227 aa, Lactobacillus rhamnosus
VVKGVNLNVANNEVVVMIGASGAGKSSVLRMINGLETVTSGEILIDGEDIAHKGTNINKVREKIGMVFQHFNLFPNMSVMGNITLAPIELGIASKEEATQQAKEMLEVVGLTDKADAMPAQLSGGQQQRVAIARALAMHPDIMLFDEPTSALDPEMVGDVLGVMRRLAKQGMTMVIVTHEMGFAKEVADRVVFFDNGTILEQGTPTDIFEHPKEERTKSFLNKVLNA

SEQ ID NO: 290 - protein, 141 aa, Lactobacillus rhamnosus
ITLSNQLTPSRNAQKYFAKYTKLRNAVAHVHQQMQENQEELDYLEGIMAQIDVASPKDLVDIRLELQQQGYLRKQKSGKKGNKRQKVSKPDQFYASDGTKIWVGKNNLHNDQLTLHTAKKTDIWLHVKDIPGSHVIIDSSD

SEQ ID NO: 291 - protein, 305 aa, Lactobacillus rhamnosus
MLTIGVIGLGTIAQKAYLPVYAQMQNQVHWLLNTRNEDKLEQLSAQYGLESAGHSLQDLDGQPLDAVMIHTPTATHYQYVKHFLEKGVHVFVDKPLATDMAQVNELYDLADAKHVMLTVGFNRRFAPMIQDLAQVTDKTGVRVDKNRIDALDDTEHALWDLFIHPVDTALMLAGYPEKPNTRYALHTTSDGQLQQASVTFTAPGIRGEAGIDLQAGTNLEEAQVAAPSGVQRVQNLDQLVVYGRGGASQTFAPDWQPMLETRGFAPMVQAFVQAVGNPDGQNPVSPATSQLAHAVVADLVNQINN

SEQ ID NO: 292 - protein, 234 aa, Lactobacillus rhamnosus
MHIAVIDDQAATREATVKLIRQLAQPSQPLQVAAYSNAEQFLFAEKSADLLLLDIKLGSGMDGMALAKKIRQHDPETAIAFVSNYDEFVFDGYDVNAIDYILKPLTVAKLKHLIEKVASQTQPKLLALQTAAGLVRVPMYDISAIEVTDHRLQVHTQKNHYLVNGQLKDFLPRLDDNFIQIYRSIVINLNFLSQLDKRTVVMADGTTYPVSRQQAPLVKQAFFKHFRGLTHDSN

SEQ ID NO: 293 - protein, 216 aa, Lactobacillus rhamnosus
LNESIVDFIRDFSQPEAALTGADGLYLAEEGIFDAIVLDIMLPELNGFDLLKQLRAKQVKTPVLILTAKDALTDKVRGFELGGDDYLTKPFHREELIMRLKALLKRTGHFFDEDGLTAGPFEVHLNRHEVLIHDKPVALNGKEFDLLVYLLQNQKTIITKDQIFDRLWGFDSDTAVSVVEVYMSNLRKKLKPMQADVWIKTIRNVGYIFQEPEDRA

SEQ ID NO: 294 - protein, 207 aa, Lactobacillus rhamnosus
TAPATAYTKMDDFLGSDVDVVYIASPNSLHASQALAALDAGKHVIVEKPLVATAMEFEKLDEALRKKPSLYLFEAARHVYEHNFQVVDQFTHHHPIDGATLTYMKYSSKYDAFLAGKLPNVFNPEFAGGALMDLGIYLVYDAVAWFGVPDNAVYLPHFLKSGVDGDGVARLDYDQFAVTLITGKTTNSFLPSEIYSGKQTLTMDNAA

SEQ ID NO: 295 - protein, 464 aa, Lactobacillus rhamnosus
MGYQVFILLLPIVTIPYVSRVLGPTGIGINAFTNSIVQYFVLFGTLGLTMYGNREVAYQRDNPKRLSGLFWELTLLRLVTTGIATLLYLGFILLSGEYQVFYLIQGLLLVATAIDVSWLFQGLEEFRITVLRNTLVKIISLILIFVLVRTKNDLWLYILILTGSQVLGNLTLVPYLKKYVVVPHWYDLKVIDHLRPTIEMFVPQIATQVYLQVNKTMLGALVGVQASGFYDNSDKIVKILLAVVTATGTVLLPHTAHSFAQGKHDEVEASLNKSMHFILVIAFPMTTGLAGIAPIFTKIFFGKGFDPVANLLVIESIVIVLIGISNATGVQYLLPTNQLRPFTTSVVFGAVANMVLNVPFILIWGSNGAMIATVLSELLVSIYQLSKVRNQLRIRSLFSEVWKYLVAALLMGVSVRVFINVLPLSNFLALLGATMYGALIYTLALVILRPKILLQMISSLRGLR

SEQ ID NO: 296 - protein, 179 aa, Lactobacillus rhamnosus
DRMTAFIQTMSHLSALQNRQLTGEAMTPATLEQQLKEEASKLVPATKTVTWKVENQMTTNESLAIAPDVVLEVFDNQLTNACRFAAEQVAIHLTATANGLTIKVDNDGPPLTPGEQAKAKLPYFSSDRQAQHLGVGMYICTQLCAAHRGHFTIANQPDTQGVSTIAEFGFLTPASSSTD

SEQ ID NO: 297 - protein, 148 aa, Lactobacillus rhamnosus
MSLPIFLELVEIRTKLASVLPFAIGTLFAVTYFHAFDWLNTLLFFTAMLIFDMMTTALNNLMDYQKAKDAHYQQEVNVIGRAQLDPGMVAKLILVMLVVASLLGVVLVVRTDWLLLLMGMACFAIGILYTWGPLPLSRLPLGEIFSGI

SEQ ID NO: 298 - protein, 269 aa, Lactobacillus rhamnosus
LKIAKLNNHPYLITSASTAQPITNAADVLTALTHRDTLTFGSEINFKPEQLEAPVAASSQIFAIGMNFLDHSQEIHIKLPEVPSVFTKFSSSLTGPTSTVPIHGPKTDWETELVVLIGKGGRNIAEADALKHVAGFLVGEDFSDRAVQFANAEPQFSLAKSFQNYSPIGPWVTSTDAITNLDQLQITTTVNGHIMQQAKLDQLIFKVPALIHYLAGIVALQPGDLIFTGTPSGTGVGRDPQIFLQPGDHVTAAISQLGALNLTMPTPQN

SEQ ID NO: 299 - protein, 193 aa, Lactobacillus rhamnosus
VIELKRIIVGITGASGTIYAVNLLQHLHRLPDVEVHLVMSAWAKQNLSLETDMKQSELEALADYVYPVQNQGATIASGSFLTDAMVIVPASMKTIAGIAMGFDDNLIGRAADVTIKEQRQLIIVPRETPLSPIHLDNLAKLAHIGVQIIPPIPAFYQHPQTIQDLIEHHTMKLLDALHIKTETASRWNGASLR

SEQ ID NO: 300 - protein, 405 aa, Lactobacillus rhamnosus
MRKQLPKDFVIGGATAAYQVEGATKEDGKGRVLWDDFLEKQGRFSPDPAADFYHRYDEDLALAEAYGHQVIRLSIAWSRIFSDGAGAVESRGVAFYHRLFAACAKHHLIPFVTLHHFDTPERLHEIGDWLSQEMLEDFVEYARFCFEEFPEIKHWITINEPTSMAVQQYTSGTFPPAETGHFDKTFQAEHNQIVAHARIVNLYKSMGLDGEIGIVHALQTPYPYSDSSEDQHAADLQDALENRLYLDGTLAGDYAPKTLALIKEILAANQQPMFKYTDEEMAAIKKAAHQLDFVGVNNYFSKWLRAYHGKSETIHNGDGSKGSSVARLHGIGEEKKPAGIETTDWDWSIYPRGMYDMLMRIHQDYPLVPAIYVTENGIGLKESLPAEVTPNTVIADPKRIDYLKK

SEQ ID NO: 301 - protein, 222 aa, Lactobacillus rhamnosus
MKNRLDDITDLMALGPTPDARDIQRRQTAHRIAIADAWQIQPGENILEIGCGQGDLSAVLADQVGPSGHVTGIDIASRDYGAPLTLGQAWDHLLNGPLASRLTVHFDTNLAASLGPVANQHFDRIVMAHSLWYFASANAFALLLKNLRTIGDYVDLAEWSLHPTALNQIGHLQAAMIQGLLYAIAPSDVANIRTLITPDTLAQIAHDNTWSYTAGKLIECPD

SEQ ID NO: 302 - protein, 51 aa, Lactobacillus rhamnosus
TYTGATIGHLSAAQKKAAYRFGRQLGMAFQMIDDLLDYTQTAKTLNKPALE

SEQ ID NO: 303 - protein, 280 aa, Lactobacillus rhamnosus
TLTDWQTAINHTLDEQLATVVNPHLRAAMAYSVDAGGKRLRPLLLLSVVAMYDGVVAEALPAAAALEFVHTYSLIHDDLPAMDNDDLRRGQPTNHKQFGEALAILAGDALLTDAFAILSQHYPGKGAELVQILAEAAGSSGMVAGQVLDMDGEQTQYDLATLKQMHQAKTGALIQAGVAMGSLFVAIPEADQAALADFAAAFGLGFQIKDDINDVTKTTAELGKTADKDVAEHKNTFPELLGLAGAKQALATQFQLATAALNSLTVDATDLKSILAVLQA

SEQ ID NO: 304 - protein, 113 aa, Lactobacillus rhamnosus
EQIQQRLEQVVTLREPQVHTLIQQQINAGGKMLRSGLMLMLARFGEPVNAELVTAGAAIEALHLATLVHDDVLDHADIRRGMTTVSAESGNREAIYAGDFLYAIYFQLLSEQD

SEQ ID NO: 305 - protein, 99 aa, Lactobacillus rhamnosus
RNLAYKAALALQRHANIRQGARIHIEKHIPVAAGLGGGSSDAAAVLRGLNSLLQLGYSRSQLARIGLQVDSDVPYCVYSETALVTGRGDVVTPLGSLPN

SEQ ID NO: 306 - protein, 39 aa, Lactobacillus rhamnosus
EKWYLVAHPGVSIPTPVIFKDPELPRNTPKRSIETLLKC

SEQ ID NO: 307 - protein, 72 aa, Lactobacillus rhamnosus
MELIEKAPAKINLSLDALYRHADGEHEWQMVMTSVDLADYVSIKPSHSIQVSTDSGFLPEDPRNLAYKAALA

SEQ ID NO: 308 - protein, 108 aa, Lactobacillus rhamnosus
IGLTTARPVLYDRINARVDTMMAAGLENEVANLLKTVPPDAQALQAIGYKELIPYFRGQADLATCVALIKQHSRHFAKRQLTYFRNQMPTHWFDLVAHPEEKTAVRCF

SEQ ID NO: 309 - protein, 73 aa, Lactobacillus rhamnosus
DQADLAALGVSSPELDRLINVALDNGAYGAKLTGSGMGGCMIALAAADQAPAIIQALKVANAVKVWEYHFETK

SEQ ID NO: 310 - protein, 163 aa, Lactobacillus rhamnosus
QMAYSVAKFKAAAEAAITDVSSRRHLPILVGGTGFYLNSLRLNLPLGGKAPPTAVRQRWQAALAENGEHWLWEQLQQQDPVAANQIESANTRRVIRALEVIELTGTRFSEQPQPQPRYETLVIGLTTARPVLYDRINARVDTMMAAGLENEVANLLKTVPPDA

SEQ ID NO: 311 - protein, 106 aa, Lactobacillus rhamnosus
TLWVPVLGNVNATWFYVIFVVFWLVGFSNAVNLTDGLDGLVAGQTTISFATYAVIAVREGRVDVLIICLVTVGAMLGFLMFNHKPAQIFMGDLGSLALGGMLAVAA

SEQ ID NO: 312 - protein, 104 aa, Lactobacillus rhamnosus
LIIISAIWVSIWQHQLTLSVWISLFILVLYGLLGFYDDFQKLVHHRNEGLKAWQKLAGQILGAVIFLIRKIAVSVSPISCFWILLKAAAKACCLVSPLPDTVTT

SEQ ID NO: 313 - protein, 154 aa, Lactobacillus rhamnosus
ARIPAHIAIIMDGNGRWAKRRLLPRVAGHKQGMQNVKTITKAASRLGVKVLTLYAFSTENWKRPGSEVNYLMRLPVDFFNDFMPDLIKENVKVEVMGELTDLPEPTRKASEKAMADTANNTGMILNFALNYGGRDELVHAARKLASAVRDGQLD

SEQ ID NO: 314 - protein, 39 aa, Lactobacillus rhamnosus
AYSELVFVDDYWPDFSPAALEAAIATYQARDRRFGGLKK

SEQ ID NO: 315 - protein, 224 aa, Lactobacillus rhamnosus
VNLETASEHRRTDVEQVNLGGLTPTYLVSKRCFDVAASFIGLVLLSGVFLVLAVLIKLDDPHGKVFYSQTRLGKDGRRFQMWKFRSMVAGADKMVDKLLKKNDVDGAMFKIKQDPRVTRIGRVIRKYSLDELPQLFNVLRGDMSLVGPRPPLPREVVKYTEYDRQRLAVVPGVTGLWQVSGRNELGFDEMVALDIHYINHASVAEDFRILFKTILVVIHPTGAY

SEQ ID NO: 316 - protein, 85 aa, Lactobacillus rhamnosus
MSATAEAKSGPVLAKAHDSRITPVGKYLRKFRLDELPQIFNVLKGDMSIVGPRPERPYFVNQFNQQEPHYYLRHNVRAGITGYAQ

SEQ ID NO: 317 - protein, 214 aa, Lactobacillus rhamnosus
QYRREAKLLKSTHTAYLKAKQMKVLVEDLFEYTKVKSTTTKLNPVRFNMIAMLEQLAASFELEAHKKHMRILVSGEPNPLMMEADTEKLGRVFNNLIVNALKYGQGGRHIFLDAQRIGSEVVVKVSNDGAQIPNDALSQLFDRFYRVEESRSQETGGTGLGLAIAQSIIALHGGYIYADSSPELTSFVIHLPLKVGASLTDKQTKSNEEAGKTK

SEQ ID NO: 318 - protein, 182 aa, Lactobacillus rhamnosus
LPLLSIATDTFVAVGLPLVLGAAFTTQRDRVQPYLRRSWPWFAVAGGGLIVFGLVGRILTMPAMTIALVPVLVSLILGAGLIWQAHQVHLNVTQTNHGVVVIGVVPQTPAAQMDLQPGDRVLTCNHIAVNNAAELYNAIQKEPTYCRLRLQQADGEIRLAETAIFAGAPHELGMILFPEETA

SEQ ID NO: 319 - protein, 101 aa, Lactobacillus rhamnosus
MLLTLADESHVLYGSDIPYTAPMIAAQMLKLFEPETYRAKMANRITKLKHFDPVMTHFKKFRALPTVLNMSSKMLTGAEILSPEMAQDILVNNGQRLLGKI

SEQ ID NO: 320 - protein, 305 aa, Lactobacillus rhamnosus
MIERMLSGALNLPQGRYDVVHLSGNWAKERHIQTQPLTQGTFSVESLRGASSHEQNPFVALHAAGQPFAVGDAYGANLVYSGNFLDSIEVNEWDQTRLLAGIHPASFSWRLDPKTSFTTPEVVLSFSSAGLAGLSQANQRFVARHIIDPQWRQKPRPVVLNSWEATYFDLNEQKLLHLAKLGRQLGVDCFVLDDGWFGTRDNDLSSLGDWFTNKHKFPDGLGHFAEEIHSLGLQFGLWFEPEMVSPRSQFFQEHPDWVVRPKRGRMSITRHQYVLDFSNPTVVNNIFAQMQRVITETKLDYVKWD

SEQ ID NO: 321 - protein, 425 aa, Lactobacillus rhamnosus
CHGCSAATLTNQGAEPVMIERMLSGALNLPQGRYDVVHLSGNWAKERHIQTQPLTQGTFSVESLRGASSHEQNPFVALHAAGQPFAVGDAYGANLVYSGNFLDSIEVNEWDQTRLLAGIHPASFSWRLDPKTSFTTPEVVLSFSSAGLAGLSQANQRFVARHIIDPQWRQKPRPVVLNSWEATYFDLNEQKLLHLAKLGRQLGVDCFVLDDGWFGTRDNDLSSLGDWFTNKHKFPDGLGHFAEEIHSLGLQFGLWFEPEMVSPRSQFFQEHPDWVVRPKRGRMSITRHQYVLDFSNPTVVNNIFAQMQRVITETKLDYVKWDLNRSITEAYSPYLAKIGHPQGEFFHRYVQGVYTLYQKLLTAFPHLLIEGCAGGGGRFDLGILFYSPQIWTSDDSDAIDGCNSIRNRTGLSVKLYEQSRDGDTE

SEQ ID NO: 322 - protein, 720 aa, Lactobacillus rhamnosus
HNRHPNQLRPFEVNPFSKNAAKHSKTNHRLTASLKVIKKCLPLTFIHGIFLNTGFKINHEIVKFLLVRGKIKSVRLIGNLKFHDFQILAGNKNFNGTLPTARTPHGQTLVITMHDETDTLAVNLKYTIVGDLPVLLKQVAYHNLSDDTLTITHAASLQLDFDDHAYDLITLTGAHLSEASVTRQPLTPGKKSIASNYGASGPQGVPATILAAPATDDFAGEALGMALLWSGNFSYTAQVDQFGNSRLVMGLNPELFSWQLKPGEPFVTPEAAVAYTTNGLNDLSHIFHRFFADHVMPLPRKNLIEYNTWESTYFDVSEAKVRAEIPKAEALGVELIVIDDGWFKNRPNDAGQLGDWVPDPVKFPRGLRPIADALHERGLAFGLWVEPEMITENSELYAKHPDWAMQYVGQKPLRSRNQLILDLSQRIVQDHLIKVLTDLVRTNHIDYLKWDYNRHFSQPGSPVLPPDQQGEVGYRYTRGLYRVLKTLRNTFPDLLIENCSSGGGRLDGGMLAYTDQTWTSDFTDPVYRMKIMNGFSLFFPLKTFVSHFTMSPNLQDSRVTPLQTRALLSLVGVTGIECPPSQLSDAEAAAVKASFAFYKANRTELQNGSLYRLHPSHPNQDQVCWLITNEAKTKALVLTSAGVVSPIPHYQHVLLHYLNPEVSYQINDKATATGAELNYAGITLPLAHGDFSATLMTLRVVSHLPQTTALPGGDIGELRF

SEQ ID NO: 323 - protein, 268 aa, Lactobacillus rhamnosus
AYDLITLTGAHLSEASVTRQPLTPGKKSIASNYGASGPQGVPATILAAPATDDFAGEALGMALLWSGNFSYTAQVDQFGNSRLVMGLNPELFSWQLKPGEPFVTPEAAVAYTTNGLNDLSHIFHRFFADHVMPLPRKNLIEYNTWESTYFDVSEAKVRAEIPKAEALGVELIVIDDGWFKNRPNDAGQLGDWVPDPVKFPRGLRPIADALHERGLAFGLWVEPEMITENSELYAKHPDWAMQYVGQKPLRSRNQLILDLSQRMFRSSD

SEQ ID NO: 324 - protein, 227 aa, Lactobacillus rhamnosus
SAYRKLLVRRWPVGWRDAGVYGSTWTSDFTDPVYRMKIMNGFSLCFPLKTFVSHFTMSPNLQDSRVTPLQTRALLSLVGVTGIECPPSQLSDAEAAAVKASFAFYKANRTELQNGSLYRLHPSHPNQDQVCWLITNEAKTKALVLTSAGVVSPIPHYQHVLLHYLNPEVSYQINDKATATGAELNYAGITLPLAHGDFSATLMTLRVVSHLPQTTALPGGDIGELRF

SEQ ID NO: 325 - protein, 126 aa, Lactobacillus rhamnosus
  VARIANT (1)...(126): Xaa = Any Amino Acid
TAPARAQLTGGQTTMANIEYDPQKQLFHXHNDTFSYIIQVIRGYLVKRYCGPALERFSGTAKLEDFSHAFNIQNDAAPFSLTTLPLEYSTLMGGDYRTPAYAVRNGHGQLITRSLSKLNTLEAIAF

SEQ ID NO: 326 - protein, 116 aa, Lactobacillus rhamnosus
MLRLLTAPARAQLTGGQTTMANIEYDPQKQLFHLHNDTFSYIIQVIRGYLVKRYCGPALERFSGTAKLEDFSHAFNIQNDAAPFSLTTLPLEYSTLMGGDYRTPAYAVRNGHGQLI

SEQ ID NO: 327 - protein, 148 aa, Lactobacillus rhamnosus
MLRLLTAPARAQLTGGQTTMANIEYDPQKQLFHLHNDTFSYIIQVIRGYLVKRYCGPALERFSGTAKLEDFSHAFNIQNDAAPFSLTTLPLEYSTLMGGDYRTPAYAVRNGHGQLIGNLKFHDFQILAGNKNFNGTLPTARTPHGQTL

SEQ ID NO: 328 - protein, 139 aa, Lactobacillus rhamnosus
QKQLFHLHNDTFSYIIQVIRGYLVKRYCGPALERFSGTAKLEDFSHAFNIQNDAAPFSLTTLPLEYSTLMGGDYRTPAYAVRNGHGQLIAKCWPKMAFSLRLSPLTVRKSALFPSPKSQVAGLFILKPVVTYWPKAAPW

SEQ ID NO: 329 - protein, 228 aa, Lactobacillus rhamnosus
CAGCYLAATGIGRGHLLTADADSDVPTKTDRSSIFILSLGGLKMLELKNISKAFNGRPVLKDVNVTIEDGKTLAIVGPSGAGKTTLLRIISGLENADGGTMIWNGQPTTAQALRKQGVIGVVFQNFELFPNLSVLRNITLAPTLQGVDQLSVHTRQEVYQSRGQLKTVLAKLDPQAFIQVTKSSLLNINYLTSLEASFSGNMTAFMANNMKLTVSRKYLPALKRLLGL

SEQ ID NO: 330 - protein, 286 aa, Lactobacillus rhamnosus
MDGWGANPKTPFSFDQQTTAINRAYNKQKTMLMPYNYTASAQSVFDGKPMVRGLFLDYPNIPEAYTDLVKYEYLWGDNFLVAPIYQNTAADEKGNDVRNGIYLPDKQQVWIDYYTGKEYRGGQVLNNFEAPIWKLPVFVKKGAVIPTTPAHNTPKAFDQTKRQFQIFPASGKNDFTVYEDDGISKKYLKGAHAQTKVTSELQKDQLTVNVDPLTGDYSGLNPDRATEFAIRTSGKPAKVTASVGGQTVKLTAVDNLKDFTAGENVYFVNKQYHTNDFLDLCSCHNS

SEQ ID NO: 331 - protein, 390 aa, Lactobacillus rhamnosus
MMPRYGLYEAHLNAYNRDTWVPVPEGTSGAIKFEDGKYYKEYQPGKIPAGQSGIKESLNGELNNYQFSARAVIDRYQKNDMPLGWFLPNDGYGAGYGQTDTLAGNLQNLKSFADYADQHGVATGLWTQQNLSPVDPANPKPDDRDFAKEVAIGVKALKTDVAWVGSGYSFGLDGLAKADAMMTQVKGDSLRPFAITLDGWAGTQRYAGVWTGDQTGGQWEYIRFHIPTYIGTGLSGQPYVGSDMDGIFGGGNPIVNTRDFQWKAFTPIQLNMDGWGANPKTPFSFDQQTTAINRAYNKQKTMLMPYNYTASAQSVFDGKPMVRGLFLDYPNIPEAYTDLVKYEYLWGDNFLVAPIYQNTAADEKGNDVRNGIYLPDKQQVWIDYYTGKEY

SEQ ID NO: 332 - protein, 102 aa, Lactobacillus rhamnosus
MLNETSRTWWQQEIFYQIYPASFKDSNNDGIGDLPGITSELPKLKALGVTAIWLSPVYRSPMVDNGYDISDYQAIDPRFGTMADFDALMAAAKELGIKVVMD

SEQ ID NO: 333 - protein, 147 aa, Lactobacillus rhamnosus
  VARIANT (1)...(147): Xaa = Any Amino Acid
MMNYIKMHSRDNARTPMQWSDHENAGFSKHSPWEKMNPNFKTINVQQALGDPNSVFYYYQKLIKLRHTLPVITDGTYALIAGNSDDEEIYAFTRTXADTTLVVILNYTNKNLTRHYDLPSHAKILISNYADDQGDNIRPYEAKVYQY

SEQ ID NO: 334 - protein, 280 aa, Lactobacillus rhamnosus
  VARIANT (1)...(280): Xaa = Any Amino Acid
MSKNTMNPSVDSKEKVETTTVDSSMPDLSMQTILAMTFGCIGVNMAFTLQGSQMSRITQTIGVNPNSLGFFFLLPPLLGMVVQPLLGKYSDKTWTRFGRRIPYLLFGAPIAAIVMVMLPFTGSFGFGYGSITALVYAAVAIALMDLFSNVCLAPYRMMAGDMVNNKQKNLAWSWQQIFSYAGGILAALLPYLLTMGGMSNTAAKGQVPNTVIWAYLIGAAILLLTTXVXVLKVKEYDXETYAKYHEIDLKKQHAKTPSLWQLTKTAPKSFWELAVVQLFS

SEQ ID NO: 335 - protein, 139 aa, Lactobacillus rhamnosus
LRGIFHTMVNAVRSSIDQFNDLSAHDNYRRALAEGYSEADALACVNRRSRDNARTPYPWDDEANGGFSDHQPWLPVAQQAPGVNWQDEQIDPDSVWHFYQKLCQLRNDSPFRSDRRCQKRNEKHRIHNNRHPEKYRFVN

SEQ ID NO: 336 - protein, 66 aa, Lactobacillus rhamnosus
GNSDDEEIYAFTRTNADTTLVVILNYTNKNLTRHYDLPSHAKILISNYADDQGDNIRPYEAKVYQY

SEQ ID NO: 337 - protein, 149 aa, Lactobacillus rhamnosus
MQWSDHENAGFSKHSPWEKMNPNFKTINVQQALGDPNSVFYYYQKLIKLRHTLPVITDGTYALIPGNSDDEEIYAFTRTNADTTLVVILNYTNKNLTRHYDLPSHAKILISNYADDRNTRCVDPFLATKNTVILNNGDKFAVLSSFSVI

SEQ ID NO: 338 - protein, 552 aa, Lactobacillus rhamnosus
  VARIANT (1)...(552): Xaa = Any Amino Acid
MSKKYLMGIDNGGTSTKAAIYDMDGHELEKTTVNTKMLTPHPFFTERDMNELWKANIYVIKQTLEKSHIDPRNISGIACTGHGNGLYLVDDKGNAVRNGIISTDDRAAAYVKKWLADPYYENEIRPKTYQTVWSSQPVALLAWLQDNEPEVFERTKYIFMIPDLIRFWLTGDAHFEITNASGTSMLNINTKKFDQDLFKFFGIERWMAKLPPLANSTDHCGSISRKIASETGLVEGTPCSGGVFDIAASALSTGLVHRHKLGIVTGTWSINEYITNKPKVVKDLFMTSIYPIADRWLITEASPTSASNLEWFINTFMDKEKRAAEDAGFSIYEYCNKLVASTKPQDSDLLFFPFIFGGNAVPNASAGFVGATKYHDLKYFVRAVYEGVVFSHMYHIEKLRRIDGHLDGAARIAGGITNSQVWLQIFANVLKQPLELXNVKENGTLGTAMTAGVMTGDFKXVEDAANHMVHISRTILPQPEFEDVYQKKYECYKKALTNMEPVWNGLQXVXIISYEDMEVLIMDLGIKGKNAIITGGATGLVTICSRISKRRR

SEQ ID NO: 339 - protein, 140 aa, Lactobacillus rhamnosus
  VARIANT (1)...(140): Xaa = Any Amino Acid
MADFEELAQKLKAAGIDIMLDMVLNHTSTQHVWFQKALAGDKHYQDYYYIRPPKPDGSLPTNWESKFGGPAWAPFGDTGNYYLHLYERRQADLDWHNPAVRQKQPLLLIFGAPXGFTVSALMCSTSLARPISWLMRHRKS

SEQ ID NO: 340 - protein, 81 aa, Lactobacillus rhamnosus
MYYLHVFSPQQPDLNWENPKLRQAIYQMINWWLQKACGLPGRCDHFHQKGSGFCSDYARWQRWSGKGEAEGRESARPGTLP

SEQ ID NO: 341 - protein, 218 aa, Lactobacillus rhamnosus
MVFPTMRKCDRASNRISVCAKHIDHRHNRQYSQRDLVKYEYLWGDNFLVAPIYQNTAADEKGNDVRNGIYLPDKQQVWIDYYTGKEYRGGQVLNNFEAPIWKLPVFVKKGAVIPTTPAHNTPKAFDQTKRQFQIFPASGKNDFTVYEDDGISKKYLKGAHAQTKVTSELQKDLLTRTEKVSAIGDFFFGINKYATSKWIHHMKRLKYNPRRFRVKLLP

SEQ ID NO: 342 - protein, 569 aa, Lactobacillus rhamnosus
  VARIANT (1)...(569): Xaa = Any Amino Acid
MLDGKPFKILSGAIHYFRVHPSDWYHSLYNLKALGFNTVETYVPWNLHEYREGEFDFSGILDIERFLKTAEELGLYAIVRPSPYICAEWEFGGFPAWLLTKKMRLRTDDPTYLAAIDRYYTALMPHLVDHQVTHGGNVIMMQVENEYGSYGEDQDYLAVVAKLMQQHGVDVPLFTSDGPWPATLNAGSMIDAGILATGNFGSAADKNFDRLAAFHQEHGRDWPLMCMEFWDGWFNRWGEPIIRRDPDETAEDLRAVIKRGSVNLYMFHGGTNFGFMNGTSARKDHDLPQVTSYDYDAPLNEQGNPTPKYFAIQKMIHEELPEVQQAKPLVKPTMAPASHPLTAKVSLFAVLDQLAKPIAASYPQTQEFLGQYTGYTLYRTQPLISGTDKGTPAKLRVIDARDRVQAYLDQKWLATQYQEAIGDDILLPEVEGHHQLDLLVENMSRVNYGSXXEAITQFKGIRTGVMVDLHFIKGYQQYPLDLNRASRLTFTEGWQPATPAFYKYTFGLTAPQDTYLDCRGFGKGVMLVNGVNVGRFWEKGPTLSLYVPAGLLHAGKNDVIVFETKAATP

SEQ ID NO: 343 - protein, 172 aa, Lactobacillus rhamnosus
MATYTPTSERAGSRSHFEGRLKFVTTFSIDHEFMLDGKPFKILSGAIHYFRVHPSDWYHSLYNLKALGFNTVETYVPWNLHEYREGEFDFSGILDIERFLKTAEELGLYAIVRPSPYICAEWEFGGFPAWLLTKKMRLRTDDPTYLAAIDRYYTALMPHLVDHQVTHGGNVI

SEQ ID NO: 344 - protein, 94 aa, Lactobacillus rhamnosus
RVHPSDWYHSLYLKALGFNTVETYVPWNLHEYREGEFDFSGILDIERFLKTAEELGLYAIVRPSPYIYSGTPGFTLYASGSKKMRRDDPTYLAA

SEQ ID NO: 345 - protein, 282 aa, Lactobacillus rhamnosus
  VARIANT (1)...(282): Xaa = Any Amino Acid
MPVPASFNDFFTDKASREYTGDFWYSRNFFVPSAAKGKALFLRFDAVTHRATIFVNGKEIRTHEGGFLPFAADISEAVKYGAENTVVVKGNNELSREALPAGDTITLRNGKKMVRPFFDFYNYSGLNRSVHLLSLPQERXXDYTTTFALAGNDAXVNYTVETNGDAPVTVSLADADGQVVATAQGKQGALQVQNAHLWQVRNAYLYTLTIQLGDDTQTPLDTYTDRILLNRRADICKDLRQCVSDAVFLECRSSDVNCCVFESAGQNSFLKFVYIDFHIGLL

SEQ ID NO: 346 - protein, 124 aa, Lactobacillus rhamnosus
QTIRLKTNGDAPVTVSLADADGQVVATAQGKQGALQVQNAHLWQVRNAYLYTLTIQLGDDTQTPLDTYTDRIGIRTIKISGTDILVNDKPIYLKGFGRHESPFAGRAFDLNIEKKDFALMKWIG

SEQ ID NO: 347 - protein, 102 aa, Lactobacillus rhamnosus
MDNSASNINVDQLTTEEKMKLTSGKDFWASEALPDHKIPSIRMSDGPHGLRYQAAAADHLGINDSVPSTSFPTASASAATWDPELIAKMGAAIGLEAQSLGV

SEQ ID NO: 348 - protein, 276 aa, Lactobacillus rhamnosus
  VARIANT (1)...(276): Xaa = Any Amino Acid
MVRSGTGNLEFIFRRGAYWNGNRTGTDWSSQPQWQVSRTYPKRYQDVVSXEIYDKHTRAVPYVESSYIGYRYFDKAKVPVAFPFGFGLSYTTFAIKHVRLVNDEVTDGQPVTVQLDVTNTGDMDGAEVIQAYVKEQQPRPLRPEKALKAFKKVFIKAGETVAVQLELPAQAFKEWQEKTQTWVLPAAAKSVAIGTSAADIVATLPVHLNGTNVTNFKNVPDWYTTLSGKPTVHDFEQLTGQKVPPHHEFVPGEFTRLNTPREMQKHSWIVRTVTRI

SEQ ID NO: 349 - protein, 106 aa, Lactobacillus rhamnosus
SSRTALMGEQPNPWDRLQPQDAMSRHRGAKPPRRCGLLGEISLLSPGLLSVERWPFHTNHRIRWHFMKFIWRRFALPLLKAIQNPSCALITKTVLIRVTIAIQTCC

SEQ ID NO: 350 - protein, 190 aa, Lactobacillus rhamnosus
MQKQGIAACLKHFAANNQENGRLSSDSMIDPVALHEIYLEAFRIAVTEGHPESVMCSYNKVNGTYTSDNRYLMTNVLRDQFGFDGAVITDWGALNDKVAALNAGTDLEMPGDDHLFDDEALKALQSGELQPASLDRAAANIIKMARKHRPSFHGTREALLHQNAQLAQKIAENAIVLLKNDDHIFAIADQ

SEQ ID NO: 351 - protein, 78 aa, Lactobacillus rhamnosus
IQGLKDWLYLFNSGQDFQSYNRFGAHEVSPGKWSFLVWAPHAQQIKVVGDFNDWRGSPLTRQGETGCWYGELAAKKGQ

SEQ ID NO: 352 - protein, 145 aa, Lactobacillus rhamnosus
MNLLTFSFMYMYNEQFVLPFSHDEVVHGKKSLMHKMPGDRYNQFANLRTMYVWQMTFPGKKLLFMGSEWGQFLEWRDWSELEWVDLKDPMNHKMQTFTKTLNHIYTNRPSLWQQDHEPLGIKITMADEPDVMSYIRYGKQKDDFT

SEQ ID NO: 353 - protein, 257 aa, Lactobacillus rhamnosus
MYWLDHCHLDGLRVDAVSNMLYMDYDAGKENDRNRFGGRDNLEGIAFLKQLNTKVFAKHPDVLMMAEESSAYPKVSAPINTGGLGFNYKWNMGWMNDTLKFFEEDPVYRHSDMNLLTFSFMYMYNEQFVLPFSHDEVVHGKKSLMHKMPGDRYNQFANLRTMYVWQMTFPGKKLLFMGSEWGQFLEWRDWSELEWVDLKDPMNHKMQTFTKTLNHIYTNRPSLWQQDHEPLGIKITMADEPDVMSYIRYGKQKDDFT

SEQ ID NO: 354 - protein, 118 aa, Lactobacillus rhamnosus
YEVHLGSFIRDTHAGPDGGYMTYQDAIDKLIPYVKELGYTHIEFLPLMEHPLDASWGYQLMGYFAPTSRFGDPADFLRLVDAAHVAGLGIIMDWVPGHFIKNTDMLAQFDGTPTFEYT

SEQ ID NO: 355 - protein, 139 aa, Lactobacillus rhamnosus
  VARIANT (1)...(139): Xaa = Any Amino Acid
MNXFHDSLATAANCQPDDPETTFSRLFDAAASMEQYPTELHFIQQNVFNEALNAESRAARGRVITLINNMLLEGQERGVIVKADVRTQLAILYGSIVSMIDIVWAQQQLEGHVSNQKPLAADLKNQVWNGLTSERRVFN

SEQ ID NO: 356 - protein, 150 aa, Lactobacillus rhamnosus
DPNAFTWDGKVYDQATGKYVTAPDGKYTYRLVTEQYNAGAQQNQDFDLPVTVDTVAPTLTGLSYQNGRVTVNYNDQGAGFTKFSDIALKIGGKAYGVSLNNNGQNNDGTLSFDLTAAQKAALESSDGSLTLTLTDVAGNKTSKTLQHPMH

SEQ ID NO: 357 - protein, 290 aa, Lactobacillus rhamnosus
MRLDPNAFTWDGKVYDQATGKYVTAPDGKYTYRLVTEQYNAGAQQNQDFDLPVTVDTVAPTLTGLSYQNGRVTVNYNDQGAGFTKFSDIALKIGGKAYGVSLNNNGQNNDGTLSFDLTAAQKAALESSDGSLTLTLTDVAGNKTSKTLQAVTGTHQATTPTATTANVAPQFSWKVGDGPYNHWRTDGFVQAVSDQTSFTAYAQVPAGVDWIVYATDAMSGKVFSGKVDTKTGNVTFNLTASAPYGDFVGTVLAPTADFGTYEQAGRANGDEMVVFLDDGSSGYGHFSQEN

SEQ ID NO: 358 - protein, 129 aa, Lactobacillus rhamnosus
PEYQMHKAPQTAAESEPLHFDLPNNDQTNQVMLNMLDSHDTPRILTLAHGDEVLALQALTFTFMQTGAPCLYYGTEMGMSGGDDPDDRKPMDWSKLGSPIWKKVAELVHFRRKHAQTLGQGSTRMSVTA

SEQ ID NO: 359 - protein, 169 aa, Lactobacillus rhamnosus
DPRTMPKLANALASKFAKEKPAKKATFKANAKKYIASLNSLNALITKLKQNVHGQKVDVSEPVFGYALNYLGYKVNNRHFAQATEEGTDYSAKDIHAIETDIKEKKIAFFVNNSQASSKTIDSFIKLAKENKVPVLNVTETLPKGKNYRTWMTDQYRQLEKIQNQTDTK

SEQ ID NO: 360 - protein, 267 aa, Lactobacillus rhamnosus
DQKMPDPSALITTMIRLAIGIVRQGINQPVNSYHRIVEQGDSTTFTGQLILKALAFYNLPVWADDFAYYLGADGQKLTVAQNDNFVAMTHRIILAVGALVDHDFSHDSQLQENLYLHLSQSLGKENQLLQYSPFTQDIKHEYPQLFAAIEKTVHKELAAYRPILNDAFVAFIALHFMVSLNRDSQLKTVRVAYICATGIGITNLIQQRVASAIPNIELVGFASIDDARALIAREHPELVISVFPLKHLDVQVIEVQPLPNATDIAAI

SEQ ID NO: 361 - protein, 144 aa, Lactobacillus rhamnosus
MEPAVKYRLIHQDKHSGARLGELITPHGTFPTPMFMPVGTQASVKTMAPEELDTMGATVILANTYHLWLRPGPDLIEEAGGLHRFMNWHKGILTDSGGFQVFSLADTRHITEDGVTFKNHLNGAKMFLSPEKAIAIENALGRIL

SEQ ID NO: 362 - protein, 120 aa, Lactobacillus rhamnosus
GFSFDGGAVNFGAVTQGAQQTESQIQVTDNLYINGNGAVRVSTPTDVNGIPQVINSSLSLLEQDDSNATIKLVDASSAVVKGNGGNLQLQDASGQVISSGKQRNIVQQGKNVAKGYTIIV

SEQ ID NO: 363 - protein, 426 aa, Lactobacillus rhamnosus
NMLGNLGRIAATVSLNIDPFQVSQRVLNSSIKATAAELRAQDAAFKGSEKSINNMRSTYDTLSRQSKNYQAQLQKQRERYDENSKAVERLNKSETASQEEINRATKLQANAASQYNRTAAAAAQNENRMAALRKEIALQSDGWTKVSNGASKFASVTEKTSSKLTSFGSTMTRAVTAPIAIGFVAAAKSAIDFNSQIQAMGPLLTNGGAITAKYRAQLDQLASASKKWSVEYGVSTAAINDGMSEMIKRGYTAAQTLGAMPAVLNAAKASGDDFNDVMHVSTSVLEQFGLKTESTTGMLKNTSRVTDALTYIANATAAGFQDMGEAMTYVGPSAHAAGISLEETAAAIGIMSNKGIEGSVAGTALRGALTRLLKPSKQNLQGFNELGISVADFKKGTLTLPEILDKIKNNTKGWTDQQRASAVAVG

SEQ ID NO: 364 - protein, 165 aa, Lactobacillus rhamnosus
WRTNTHIQPDTGLINDPCSLNFFNGKWHLYYQQFPFGPVHGLKSWAHVVSKDLFNWRRVPGDLLPDNELDAQGAYTGSALVTHGTLRIMYTGNVRDEQWHRQSTQLGAVLGADSRLYKDPKPLIANPPAGYTQEFRDPFLFNYQDKTYVLIGGQAGRSHRRHPTL

SEQ ID NO: 365 - protein, 576 aa, Lactobacillus rhamnosus
  VARIANT (1)...(576): Xaa = Any Amino Acid
AYAKGHLGISVLGNGGGVGLQAGAKASIDGSDLDSHEASSGSRASHDARXESMXLATDPATTQQLSQTLAVPPFLATLLWQRGIKDKAEYEAFVHPDISRLHDPFALHDMDKAVARILEAIEQNQKITIYGDYDVDGLTSSSIMLETLQSLGAEPDVFIPDRFTDGYGPNAEVYAYLQKTGTQLVITVDNGVAGADVIDPAQAAGMDVVVTDHHELPETLPHAVAVVHPRHPEGHYPFGDLSGAGVAFKVATALLGEPPLESIDLAALGTIADLVKLTDENRIIAQLGLKMIQTQPRVGLAAILKEAGVAPDTVNETTVGFVIGPRLNALGRMGDANPGVTLLTTFEEDVAADLAQQVGKLNQERQGLVSKIAQEALTMAQTPENQAAKTLLLASKGWHEGVVGIVASKVVEATGKPTLIMNIADDGDTAKGSGRSIAAYHLFNALEPAEDKMVHFGGHHMAVGLTAKTAELSAIHAQMEAAAATMLKTVPKPALPIAARLEVGDLTLEHYQLIRQLAPFGQGNPEPTFSVRPQVVQNVKPIGKENAHLRFQIDQGVNVIGFGFGSAAATLAEAQA

SEQ ID NO: 366 - protein, 320 aa, Lactobacillus rhamnosus
MNKAVLSKHDLMTVGEAPGVTPALALQYTGFDRHELEMVFQFKHVGLDNDPQFGKWSLKHPQLTDLKRVLSDWQTALHGKAWNSLYWDNHDQARAVSRFGDDRPAFRVHSAKMLAATLHFLEGTPYIYQGEELGMTNVAFPSIHDYRDLDTLNAWHELVEQQHALAPEDMLKRIHRRSRDNARTPMQWSPAPQAGFTAGTPWLAVNPNYTDINATAALADSDSVFFFYQKLIRLRKQYPDLIVYGAYTLLDPDDPDVYMYQRHAAKQELLVISNFTDQTLTRDIAKQLSPSAKLLISNYDDDAENTLRPYETKAYLTSER

SEQ ID NO: 367 - protein, 306 aa, Lactobacillus rhamnosus
MHKSWWQEAVVYQVYPRSFQDSNGDGIGDLQGIIQHLDYIKELGADVIWLNPIYKSPNADNGYDIADYQQIMPEFGTMTDFQQLLKAAHARGLKMMMDLVVNHTSDEHPWFQAAKQSRTDPHHDWYIWRDPVDGHEPTNWRADFGGSAWTYVPEVGQYYLHLFAVKQPDLNWTNPAVRKAVFDMMTWWCDQRIDGFRMDVINLISKPDVFADDPHLLEQPNGNSLGLIANGPHVHEYLRAMNKAVLSKHDLMTVGEAPGVTPALALQYTGFDRHELEMVFQFKHVGLDNDPQFGKWSLKHPQLTDQ

SEQ ID NO: 368 - protein, 527 aa, Lactobacillus rhamnosus
MAPVSGLAMAITDVSDPVFSQKMMGDGFGIEPTDGQIAAPVDGRIMMIADTKHAIGIKADDGAELLIHLGIDTVELKGAPFEIDTAMDARVKAGDVIGSMDLDAIKKAGKKTTVIVAITNTKEVVDQLDVTPGEVKRGEEVAVMTPKAAAVEQAPATPKNESKYAATARQIIADVGGAQNVNSLIHCITRLRLYLKDEQKPDDDTVRNIPGVIDVARANGQYQVVIGQAVTDVYDEVIKQLGPGYSNAEGTAKAIQETQAEAKDTSALGTIKRWAQALIGTITGSMIPVIGLLAASGMLKGILNILTTWFGLKTTNPTYEIINAMGDAAFYFLPVIVGFTAAQKLGSDPVIVGIIGAFLIYPSIAKIATAGKVTGTVLGMGINANFFGLPVHIANYTYSIFPMIFAAWMAAKIEPWIKSWMPLVLRMIFTPLVEIFLVGMTVVLAVGPLITVLSSGITAGIQALLSLTPMISDAIIAGFYQVLVIFGLHWAVIPVITAQLSSAHPESVLNGIVSISMIAQGAGALAV

SEQ ID NO: 369 - protein, 117 aa, Lactobacillus rhamnosus
MNYQTRKRLSLPVLVGFNSSCHRTLTLRNGSLVSRVLMYRLKKRSKALNKFWKASTMTIQKMHSVQLDGLKKSLKRLKRWALLLMIRTRMLTKSQLHKLQLTKEATRFGRNEQCSAG

SEQ ID NO: 370 - protein, 182 aa, Lactobacillus rhamnosus
IGFSSSHMQSLLRFGSEGSHGAQITLSCSMYLCFQCQRAIRRILPVEKWWKNAVIYQIYPASFQDSNNDGVGDLRGITERLDYIKKLGVDVLWLSPIYKSPQVDNGYDISDYQAINPTFGTMKDFDELLAKAHSLGLKIMMDLVNHTSTNIIGSKNHEKAKITRIETITSGEMGKMAQRQTT

SEQ ID NO: 371 - protein, 246 aa, Lactobacillus rhamnosus
  VARIANT (1)...(246): Xaa = Any Amino Acid
MQHPYDSFEPVVDFIREAAQDPQVLAVKMTLYRVSSKSPIIRYLKKAAENGKQVTVLVELKARFDEENNVHWAQELEHAGCHVIYGLVGLKTHCKLALVVRREEDGIKRYMHMATGNYNDVTARLYTDMGLFTCNNEIGEDASNIFNMLSGFSEPPYFHKLVIAPLGIRDYLMDRVDEEIAAAKAGRKALIQMKMNSLSDTAMIEKLYXASHAGVEIHLLIRGICNLKVGIPGVSDNITGHSIVGQ

SEQ ID NO: 372 - protein, 133 aa, Lactobacillus rhamnosus
FFTGSAWKYDAQSNQYYLHLFAPEQPDLNWENPTVRHSVYDMMNWWADKGVDGFRMDVINYISKPEGLPDGKKGKQELYANPEPLVANGHHVHEFLREMNQTVLSKHNLISVGETPSVTVDELKNMPALTTKN

SEQ ID NO: 373 - protein, 283 aa, Lactobacillus rhamnosus
AHCGSSGDGTINEVVNGIAPAKKRPKMAIIPAGTTNDYARALRISRDDPVEAARVILKGQTLAMDIGQANHHYFMNIAAGGLLSELTYSVPSEVKSIFGYFAYVIKGAEMLPAVRTMPMKLEYDGGVYDGPASMFFLGLTNSVGGFEQIVPDAELGDGKFSLIIVKTANMANLLKLMALVFNGGRHVDDPNIVYTKTKKLKVKTSGQDTLKINLDGEYGGDAPMTFVNLKQHIAMYANVDEIPTKNLGTDAQKQRDYMAEVESISHRDIDGDGQIGAQDEKDD

SEQ ID NO: 374 - protein, 82 aa, Lactobacillus rhamnosus
NSVTVGEMSSTTIKNSIAYTKPENHELSMVFQFHHLKTDYKNGEKWSKMPYDFKALRNILHTWGQQLDQVRNWQSVLTDTGV

SEQ ID NO: 375 - protein, 55 aa, Lactobacillus rhamnosus
DYLKALHIDMIWFNPFFVSPQYDNGYDVADYRQIDTPLISIPRAAKSLATTYYLR

SEQ ID NO: 376 - protein, 134 aa, Lactobacillus rhamnosus
TTICGVTRSCPVIASHQHKPADYIHQKNASESNQIETRGAYKTDYQNQHLRYPPAYPDISRRTPNHAAIILMQSLDGGGQAPRDSSTLPWSHPPPPWQRQPAPADRIRDRCHEWSLLRSRYNRQCHLLNRIRSI

SEQ ID NO: 377 - protein, 182 aa, Lactobacillus rhamnosus
LLFLDRLPIKQFRGVGKKTLPKLTDLGVTNGKTLRALSQDQLLTMFGKMGFILYQHARGVDNRPVAVHTAKSIGKERTYGTPLTDATAVETQLRKLAAMVVTALNQKGMHGKTLVLKVRDVDFVTQTKRLTQDHYFEGEQAIYTAAWQLWQEVKLTKLAIRLLGITVTGLDPKQYENIDLPL

SEQ ID NO: 378 - protein, 129 aa, Lactobacillus rhamnosus
LVYAPAIDQKIIGSQTALADFKTNLGNNYSVTDYGGQIQNRFIPATEALAQSYNIPAVNLYKHIKPSVNVKAYMEKMGINTLTDNDYSQLGLALGGTDYGVDVKEQASAFSTFANQGEHVPAYVISEIV

SEQ ID NO: 379 - protein, 153 aa, Lactobacillus rhamnosus
SQLNLIGHSMGGVTAVLYLLSKPAVPVANLVTIAAPMNDLEVAQRSPILNWSLTRQGPEHTAPIYQQFQRTIDNLPADLRWLNIAGDLMLGGRHDGEVAINSSFAVRYLVKDRIKDYTEVVIRGPRAAHSLLHENRLVDHDIVEYLWQQQRDF

SEQ ID NO: 380 - protein, 120 aa, Lactobacillus rhamnosus
MLLKDFLDKDLVDIRPEPAKDWHDALQQAAGKLIEHQYILPGYVDEIIGNVEKNGPYIVIVPGVAMPHAMAESENVLGTAIGFAKFPAPVVFDPADPEKKAQLFFTLAAKDPEQHLQNIG

SEQ ID NO: 381 - protein, 164 aa, Lactobacillus rhamnosus
SLWPRADRFRYRPIGLNRTQNSHILQLRSDVQEGLEAIMWLAIGMPSFSPYVPFYCNANDTDPSYSKTPKTFDIDADSAYWLHRLLDVLVEAHYTQFIQADRDYLTALNRDYREMIQGFDKGAKELGAKELTQYLTDANYKIVAHTKAATKALINEYVMESLKL

SEQ ID NO: 382 - protein, 88 aa, Lactobacillus rhamnosus
MWLLERKICLTFVWIPVEFRYDKAPLIARWSRGDAAFSARKHGFESRTGEKNKYDETESSECLYNGVSGVFVSGRKDKRGFTVNQNSL

SEQ ID NO: 383 - protein, 317 aa, Lactobacillus rhamnosus
MADEEAMLAKVQASWAQTAARDKARYADERVPEDVHWETEYRYEQSADPQQTLNLYYPAKRRNATMPTVIDIHGGGWFYGDRNLNRNYCRYLASQGYAVMGMGYRLLPDVDLRGQIQDIFASLRWLSHFGPQRGFDLDHVLLTGDSAGGHLASLVACIQQSAELQELFGVSRVNFNFTLVALVCPVAEPSKLPEAAGDMSDMAAFYLDKLSGGDQALADHLNFSQVVKGLDLPPFMLIGGQNDSFYLQSQALLKVFDANHVTYTTKLWPASAGPHLKHVFNVQHWEWPESIETNLEMLRTFDALSKQQDQAEENEFE

SEQ ID NO: 384 - protein, 355 aa, Lactobacillus rhamnosus
MTPEAIRALVDRYQNMTRKQALKFARANLKLAGQGNKGIGLMNTKTDPTIGEDGISRITVSVDQQAPTKAYLMIEVAPDPSTELNVDLERKSSPMLVVFPVTDPISGNPLQTIHLYPKNVGYVRDPYFFKFGVHPDGTSKRLAGAIFAIYRIENGKKLYLDMSPVTDLRNKWVSTTDPLHDDRVNKFVSDQDGLVNTGERFLPAGEYFFEELQGVPGYEVDAKSRAIKIEIPDSWEDEDGNRRFVLIDGQPMQENFGGVVTPEMISSGYPRVYNYADKQAPTTGDQTAGPSTTQLGNHGQDTNGTGTHTPKRQSGYLPAMSDWRNLRFVLLGSLLLLLATYFFIKNKKARHHACK

SEQ ID NO: 385 - protein, 153 aa, Lactobacillus rhamnosus
MTQNDYTQLHNLGIKGVVVKVTEGTYYTNGIAANQIKFARNAGMVVSAYHYATFDSASAAVAEANYFANRLDSLNVGKNVTVVADIESDAVSGDIAGNLKAFWQTMTQRGYQNHVAYTMRYYKHLDALTSTTGKDRTWIAQYPYTPSANSLWD

SEQ ID NO: 386 - protein, 127 aa, Lactobacillus rhamnosus
SDSWFRKLADLGVKAVVVKLTEGTTYQNPKAAAQLAAGRRMGMQVHAYHYAHFHNSAEAVAEGRFFGVTARALGVSTQSVMAADVEAPDLTGELTGLTNVFIQTVKALGYPHTDLYTMANWMKTRRF

SEQ ID NO: 387 - protein, 140 aa, Lactobacillus rhamnosus
MSIGVYHVFSFETTPQAQATQFIRKVGSNIGDLPIGIYLSYYREQKPSSAWLTQHLTEFITLVQQRYHRQVLLMGSPDILTAVKTVVPKAPRWTITDKRPANNGGFWQYTDGARLPDGPQASYRAAVFMGKRSTFLKLAQ

SEQ ID NO: 388 - protein, 300 aa, Lactobacillus rhamnosus
MPSDSYSDWKNISGYTNLGHQSLAYNYLGFKLGKWDDKKSENVYDPNSKMANKSLRQAMGYALNNDQVAAKFYNGTRSRATTLIPPVFGKDVHADIDGYDLNIDKANSLLDKAGYKKGKDGYRTDPKGKKLTIYFATMAGGSTAQPLAQDYIQQWKKIGLRVKLTTGRPIEFNSFYDKVQNDSKGIDVYAAAWSLSSDPSPMDLFSQKAPFNYTRFVSAKNTKLLNDIDSQKAMDPAYRAKALKAWQKYANDEAFVIPTLYRQEIFPVNKRVKNASVDYASAKYLNWSKMTVTSNSRATK

SEQ ID NO: 389 - protein, 82 aa, Lactobacillus rhamnosus
LIQCLRRQVNIKVLLLFGDGRGKRDFLGILWRTGGGLVNNLRKVAITNHDPIKIISQTQCQYRLGGLTATSPAQTYRQHPSS

SEQ ID NO: 390 - protein, 275 aa, Lactobacillus rhamnosus
  VARIANT (1)...(275): Xaa = Any Amino Acid
MSAVGLLPIAVAGGDIDEMMRGLGDGRKAYASADLKENEAYQYAALRNILYRKGYTTELLENYEPTLQYLXEWWKQLMGESEGKDQKGIYPSSANFSTDLHSLGQYIQEGLRNLMETVVWVEEPNRDLTIPDDAQNLDGLGYLAGKKMSFVNRKAYEGVVLAHTDGGVPVMTISIPKQDAYTLGYLIYFFEAAVSISGYLNGITHSTSLVLKLQPLKFQLPAMQHNDFFLTKLPPFQDDYNAESQVVSSSIVSAMFYTHHRITGERADFSMQPTR

SEQ ID NO: 391 - protein, 141 aa, Lactobacillus rhamnosus
  VARIANT (1)...(141): Xaa = Any Amino Acid
DPELKFPEVYFAGNSISGTYLADLLDIIGDRDFSINVXSKSGTTTEPSIAFRILKAKLIEKYGKDGAKERIYATTDRAKGALKQEADAEGYEEFVVPDDVGGRFSVMSAVGLLPIAVAGGDIDEMMRGLGDGRKAYASADL

SEQ ID NO: 392 - protein, 106 aa, Lactobacillus rhamnosus
MNYPLRSMLIDFVNGQLSAAGFVRQLMTLKENYPPNAFAFNFNNIGTHDTARILTVLNGDRRKLQLIVSLLYWLPGVPCLYYGDEAGLTGGKDPDNRAFYPWGHED

SEQ ID NO: 393 - protein, 138 aa, Lactobacillus rhamnosus
MHVILDGVFNHVGADSRYFNAVNEYDDVGAANSLDSPYASWFSFKRFPDDYNSWWGVKDLPAINKDNQDFHNFIAVKKDSVISVTIGSGWPARCFAALVFFFDTSGDHGYHHFISELFIDGSPKDNIDIIFSCIRNDL

SEQ ID NO: 394 - protein, 133 aa, Lactobacillus rhamnosus
MNTPHALDIIEEGNAQYGDRIKIGAGTVTTLTEAQDAIAKGAKFMLSPIEFTDDIFAYAKQHGVITVPAAMTPTEVHTMFEKGADIVKVFPATTVGSGFFKAIQAPLGKLPLMAVGGVSIWAWMAGVWMSPMS

SEQ ID NO: 395 - protein, 156 aa, Lactobacillus rhamnosus
MRVMLDAVFNHMGFGSMQWQDVLRNGEASRFASWFHIYQTPVTPFHNPLKNAGQPQYDTFAFEEKMPKLNTANPEVQEYLLTVATYWIKTFDIDAWRLDVANEVDHHFWKRFYATVTAIKPDFYVLGEVWHRAQPWLNGDEFSGVMNYPFTQQIED

SEQ ID NO: 396 - protein, 164 aa, Lactobacillus rhamnosus
  VARIANT (1)...(164): Xaa = Any Amino Acid
MKKEGRIMNLAALLHRPESEDCFLYTDEAMRVRFHTARADVAKVTVLYGDPYWQLPDADGTNKLIYQRRSMHLIGHGQTRDHWEVTLEAPYRRLQYLFEVTGQDGAVWLYGDRGVRENHAAARHKAENYFRMPYFHAIDRVKTPDWVKQTVWXQIFPERFANGD

SEQ ID NO: 397 - protein, 379 aa, Lactobacillus rhamnosus
MVVAVIDSGVQAHDDLRLSDDSTAAITKEKAEAAISKLGYGSYVNSKIPFAYDYVNNDSVNTGTTVAGSTHGEHVAGIIAANGTTADGATGNEKATTYVKGVAPEAQILAMQVIDEFADENANDISRAIRDAVTLGANAIQMSLGIGVTEQDLTDEEQAAVQYATDHGVFVSISAGNNANAGSIIGSKTSNDISTAYSPKNDSTIGDPGAAASAMTVAAEKSATGDKSEMDGFSSWGPMADYTLKPDISAPGDNVISTAIDPTTNTQTYATESGTSMAGPYNAGAALLVMQKIKATRPDLQGADLVKAVKLALMNAADPMKDINYPDTYISPRRQGAGQIDVSKAGDLTVSAEGNKDAGSVSLGKIGQTTSFTVTLTNH

SEQ ID NO: 398 - protein, 146 aa, Lactobacillus rhamnosus
MPTPTTVPIFFSVDDGYVPCLAVALTSIRANKNPRVNFEINILNNGLLPANQKRLAALGTSNFDIRFIAMDKVTRQISGDTNKLRGDYVTLTIYFRLFIADMFPQYDKAIYIDADTVAEDDLTTLFATDLSDNLVAGVADRPAGCW

SEQ ID NO: 399 - DNA, 2499 bp, Lactobacillus rhamnosus
gcgccggaatcctgccaatggttcgtcatcgaaactagccaaaaaagccggggcgtctgagcctaataactgggtatatttttctttaaacgcttcaggaagttgcacttgttcgatcctttaaattatccggaagagacttttcaaagtttcgacagcgcttttaacaacggagctgattacgttgagcttgacgtacatgaaagtgcagatggtgtgattgtgattcaacatgacaccacgattcagcgaacgactggtgccaacttggcgatcgcgaaaacaaacttcgcacaacttcagcaatatcataccaaaaatggcgaaccgattcacagcctagaggaactcttcgcccatgagcaacaaacaaagcataaattcctgattgaaactaaaattgtaaaaggtgaaccgcatccgcatctagaagacaaagttgcggccctgatcaagcaatatcacatggaaaatcgcgtgatgtttcattcattctcagcagctagcctcaaacgcttgcaagcagctctgccaaatattccgcgaattttgatcgttggctcgcttaagcggatcaactttgacgtcttgacgtacgtggacggtattaatctaagttccgatttagtgacgccgcaacttgtcacccaactgcatgatctaggtaagaaagtttatgtttgggatgaaatgaacgaggatcgggcgaaatggacttggctcgtcaatctcaacattgatggcgtcgtcactaattacaccagcctcggccacgaatttcaaacgcttaaggcagctgctgtcaccaccagcatcaatgatcttggcgcaaactcaagccttgctgcactgccagtttatgaaaatccttatcagccattgttgcgctctgaacggctggcaccgcaaaccccgatcatgatttccagcatggtttccctcgctggcagcacgtactaccaaattggcgataatgcatttgtccctgccgaaaccattaaccttgcccctgaagccggttgggcaagtctttttctccatcagcgcatcgtcatcaccagccggcactttaaggtacccgtgcacgctgatcccttacatcagcaagccattaccggccatgttggcaatcacaaatgctaccgggtattagcagcccgttatcaaagcggccagctgtatttaaaaacaaaaatcggttggttaaacgccaaagatttacaggtgctgccaaccgccgagaatatgcgcatctggctcacgctctatcgcagcatccccgaaaaccaaaaaccgctccttcactgggcacttggcgacacggccttcgatacaccgcttctcaatgccagtgtcctgaacatcggttaaaaacttgagttgccctatcaataagttcgtcgtctgtcttcaccacgcattatcaatgatcgagtcattcattcgtgtctatgccttaaacatgctattcttaagacaacgctattaagaaagtaggttaaccttatgaccattaattggcagcaagaagttgaaaaattggaaccccaacttctctcagatctaaccacacttttgaagatcaattcggaacgtgatactgatcatcaaaccgatgagtatccactcggaccgggaccggccaaagcgcttgaagcatttttggcgattgcacagcgggacggtttcaaaacattaaatgtcgaccatgttgccggccgcatcgaattaggcgatggcgatgaaatctttgggctttttggccatgttgatgtcgtgcccgcgggaccaggctggcaaaccgatccatttgaccccgttattcgcgatggcaagatttatggccgcggaacaagcgatgacaaaggcccaagtatcgctgcttactatgccttaaagcttattcgcgatctcaagttgccgattaataaaaagattcacttcattcttggtaccgatgaagagtctgactgggtcggtattcaccgctatctcgaaactgaacctgctcccgacttcggattttcaccagacgcggaatttcctatcatcaatggcgaaaaagggattgctagttttgaaatcgttcaaaaaccaatcgccgctgcaaccgctgatctaacgttgaatcatttttccgccggtattcggccaaacatggtgccacaagaagcaaaggctgtcctcagcgggccattaccggaagcatttgtgacgcaagccgagaaatgggcagcggagcaagaagtcaccctcactctgacactaggcaacccgacaacgattgaattgattggaaaaggcgcccatgcccaagaaccaaaagatggcaaaaacgccgcaacctatttagcaacgcttttggccgacttaccatttgatccagccgggaaagcctatctgaccatgattgccaaccaccttcatctggactcacgtggtcaccatttagggattaattataccgataaactaatgggtgacctgaccgcaagtccg

SEQ ID NO: 400 - DNA, 2039 bp, Lactobacillus rhamnosus
atgggtacccgcccacggttcgcgaaatcggtaaatcggtcggactcagctcttccagtacggtcgcggcttacttggagaagttgctggcggctggcttgattgctaaagatccgtctaaaccgcggactattgaagtcacagcagcagggcttgattttattggggttcaggcacaaggaatcccgattgtcggaacggttgccgcgggggttccaattacggcgattgaaaatattgatgattattttcctgtccctgacgatcttccgtattccgccgatgaattgtttatgcttcgggtccaaggcagttcgatgattaagatcggcattttagacggcgatcagattattgtcaaaaaacaaaatgatgccgaaaatggacagattgtcgttgcgatgaccgaagaggatgaggcaacggttaaacgtttctacaaagaaaagcatggcgttcgtctgcatccggaaaatgatgatatggatgacatgtacttccccagtgtcacgattctcggaattgtcgttagtttatatcggccggcgcttgtgtaatcagctcataattcagtaagacgaatcgctctcacatcaaaaagacatttaccaactactttattcgaaagtggtgggaaatgtctttttgattatgtatcctgatgtcaacgttgcaaatttcaaagttgggcgaggcgaactaactaaattactcttggctaattaacggctgtctgaactgattagtcggctaaacgaatggtgccgctcgtaaccaccatggtaccttgggccgtttgtaacagtaaggcaccattatcatcaaacccgctgatggttccggtcagcgggttttgtgtgccactcaccgtaattcggcggccaacccatgcagcttttgcgcgataaatcggcataatggtttccggattggcaaatagacgcatcagattggttaaaaatcggcctgccaattctggacgcggatcgctatctggctgattggcaagtaacgtggtgatcggctgatcggttggcagcactgctgattgagccggaaaaagatcaactccgatgcctaagaccacagcgttgtgttcaatgagtgcttccgctaaaatgcccgcaaccttgcgaccacctttttgcagatcattcacccatttgatcgcggttacaatgccaaactgggtttcaattgcctgctgcaacgcaacccctgcagctggtgtgatcagggactgactgatttgcggatggaatgcgtaactaagataaagccccgcatcggcaggactggcaaaatgtttgccatggcggccgaccccggcagtttgttcaccggcaataagaatttggggaaccgtactgttattttgaacggcgtgttttaaaacggtgttggtagaggtcacggttgcttgagtagcaacggctgcacgcaaatgaggatcgtctaaccatggatctaaagcatgaggtgtaaacatcataagcttcctttctgatttgcatcgcacaaacgccaggagtcaccgcaacattgtgagttgccgacttctggcgcttgggttgcatgattagtttaaagagcgtcaaggcgttagtgttcgcagcgcaatcaagcgggcaaagtcacatcactaaccggctaattgcatcggcatagatggcgactgctgccacaatgtctttgatcggcatatattcatttgcctgatgcatgacattttcctggcctggcatttgggcaccaaaggcaacaccgcgtttgatgatacgaccataagtgccaccgccaatgacttgttcatgaccggggatgcctgtgtgatcgctaaaagtctggagcaatgtcttgacaagtggatcgtcaccggatacatagtgtggttcctgagcgtgaccgctgactgccacattgtactgatctgctcctagcgccgtttcaatctgatcacggattttggctgcatcggttccttgcgggtagcggacattgaccagaacgctttggggaccgtcttgcgtaaaggtgaa

SEQ ID NO: 401 - DNA, 11935 bp, Lactobacillus rhamnosus
gatcccggaagaaattgcgcgcgtgctaggacgggatcagcaggcaaacaaaaccgttgacctgctcgtgcgacggcggttttgggatgaagaaccgatgaccgttgagcacgttgcaatttgccatgaatacattgaaggcctgcaagcacacgactttgagggctcgctttttgccttaattgaaaagcgggtgccgattgcctattcgcatcaggaagtcgaagccgtgctgatcgacccagacatgatcaaattactccacgggaaaaaagacgatccgttactactcgtccattccgtcacctatactgccgatgccaagccgattctttacgatatttcgtactatcgcgctgacaaatattcgtttaagtccacgttaacgcgggatcgggtgtgaatttaaggaagtaagtgcgaatgaaaaatgaaacgctagcagctttatatgaggcgcaacggatgacttttatccaagcattgcgccaaatcatgcaaattaaaagtgttcgcgggtcgcaacaagccgatgcaccgtttggccggggcccgcgggcggctttaaccgctgcggcagaactgggaaaggcttatgggtttaaaacggggattgttaattcggcaatggcgtatattcagtggggtgacgatgaccagcattatatcggcatcgtcggtcacttggatgtggtaccagcgggcgaaacggattggcattttccaccatacgacctttcggaaaaggctggccgcttatatgggcggggaattctcgataacaaaggcccaagcattgcctgtttatttgcgatgaagctgctcaaggatgccggttttcagcctaagcggacgattcggttgattttaggctcggatgaagaaagcggttcggcggatgtccctttgtatctcgccaaggaagccccgcctgagtttggtttcacgccagactgcaaatttccggttgtatatggcgaacgcggcattgtgaattttaacctgcgcacgcccatcaccgatgattctctcgacaaagtagccaccatcaccggcgaccaagcaagcgatcatgtgcctgaccacctgcaagcaacgatcaatgacaagcgctatactgccagtggcatccgcgcgcccagcaatgccccagagttaggtaaaaatgcgatcacaaccttagccaaggaattgctagacgaacacgcgatccacggacagtttgccaactattgccaatggttggtgcaaacgctggcgaaccagcaccacggcgaagggctagggatggattttgccgatgccgcaagtggccgattgattgtgacaccttatcagctgcaaaaaatcggcgcggtcatcagtctgcgagtggcggtccgctatcctgtgacttatcaagagcatgacgtcacccgcgcgctgactgcagccgtttttccccgcacccaaataaccgtgattcgcagcatgccggggatcctgcatgacaaaaacgatccgcggctggcagcattgacgcaagcctatgaacaggtgacggggcgagagggtcaaccggtcaccacaactggggcgacttatgcccgtaaaatgccaaatattgtggcattcgggccctcttttcccggtcaaaaaggcattgcgcataaggcggacgagtggatggatgagcacgatctcaagttaaatatgatgattgatatgaatgcgatgattcggttaggagcgatggataaatgaacgaaacagcttggggcgtgattgccacttggcgcatggcccacgatggcgtgaagaaagccagccagctgctgcaagcaaacggcacagccggggatgcagtggaggcattgatcaaaaccgttgaagcatacccttattacaaatcggtcgggtatggcggtttgcctaatgaaaatggcgaagttgaaatggatgcggccttcatggatggcgacactttggcccaaggcgcagttgctggcatccatgaagtactccatgcggtttcggtcgcccgcgcgctcagtcatgatcattacaacagcttccttgtcggccaaggtgccacccagtacgcccagttaaatggcttcgaaatgcgaaatatgttaacagaccgagccaaaaaacgttgggaaaagcgccgggcagaacttgctgacgccaaaatcaaaccttacgatggccatgacacggtgggcgctattacgctggcaccaacaggatcgatggccgcggcaacctcaacatcaggcttatttatgaaacgcccgggtcgagttggcgattcgccactgtccggatccggtttttatgttgacagtgacatcgggggcgccgcggcaaccgggttaggcgaagatatcatgaaaggctgtctatcctacgaaatcgtacgccgcatgggtgaaggccgtacgccgcaagaagcttgcgatgaagcggtttatccgtttattgaaaagttaaagcgccgttatggtaaagccggtgaattttcgctcatcgctttagaccgcgccggcaattggggagtcgcaacgaatgtggaatttaccttcagcgtcgccactgccagccagaaaccggtgatcctcatggcaaatcccggtccgaatcaaacgaccacgattacgccagtcacccaagcatggctggatgcgtatgaaaaacgaatcaaggcgccgattaagtagcaatcgtgcactgtggaagaaaggattaccatgaagcagtacttggcaattgacgtcggcggcacctcgaccaaatatgcgttagtatcggagcaaggcgagctcgcggagaaacataaacagccgaccgcgcgcaacagtcgggctgaatttatggcggcaatgacgatgctgatccaccgatatcaaggacaaattgctggcgtcgggttggccttgccgggtgtcgtcaatcagcagcaaggcatcgtcaaaacctgtgccgctctcccgtttctagaaacaatgccactggctgcgcgacttaaggatgctgctcatttaaacacaccagtcgtgattgaaaatgacggcaatgctgctgccctagccgaacattggcaaggcaagctcgccggcaccatcaacagcgctatgatcgtgctcgggactggggtaggagccgcactgtttttaaacgggacactctataccggcagccatgatgtcagcggtgagccgagtttcatgattaccaacggcctcaaccccatcacccgtgcgcaaaccgccgccggactctcagcagtcaaaaccgtcaacgccatggctgctgcccaacacattcgcggccacaatcttggcccacgcgtctttaaaaccctcaagcctgacacacccgccgctgcaatcctagccaccttcactcaaggcgtggcggcgatgatctacaacatacaaaccgttctagacctggaaaagatcgtcatcggcggcgggattagcgttcaatcacgtgtcatcgacgaaatccgggcacgggttgctacctatctgcaagtaacgccacttgcagcgaggacgattaagcttccggagattgtggcagctaagtatcgcaacgatgcgaatttagttggggcggtggtgccgatggtggcgcgttaagaagtgtaacgcggtgatgatgcaaaaatggtttgtatgtaaaaaatcaatcgttttattttcatttcacctaatcctggaaggctcgcaaagcaaaaaaacaggcattataccagcccaaaacactggtacaatgcctgttttaatttacagataaaacacatcccaaccgaatctacgcctcaatgcgctgccattcactcatggcgcttgcttaaaatgctcaacagtaagctgaaatccatgacgcttgagtacggcagcataatcggaaggcaaaggttgatcaaagcggaagtggatgagtgacttgatttcaccgttgtctgcccggacgccgaaaatatgggcatcgccgggctcgactggcagacagtcaataacggtttgctccaggtcaccgcgttgtttggcttgaatcagcgccgttaagagccgatcaagatttgtaatggtgacgggctgcatactctcaactccttcctttcctattcaaccttaaccaagattgattggcttagacgcgctttttacgtgatacgaatcctgccaagccgagcatgcttaggattgcaaggccaagaacagccagtggactttgcgcttcaccagcttgcggcatggttttggctgcggcggtttgtttggtgttcttgccagtttcagcagtagtaccggttttgtcttggcccttggtggtgtttgtcaaatcaacgaattttggtgtcggattggttttgccttgctcatccgttttcggagtagtggtaggccctttaggattttccgtgccggtttgatcgcccgtgcctggttttggcgtcggcgttggcgtcgtcggtgtttctggcgtcgttggcgttgttgccttggtcttaattacgtggaagaccttggtgactttattgccgaccatatcaaccgcggtgatggtgaagtaattgtcgccgtctgctaattgataggtttgcgtgaaggcggccgcaccgtatgggttggaagtcgttgacagcggatcgaggtggttgttgaacccagctagattcttctggtgcacaatgttatcgccgtttgtgtagaggcggtagccattgatgttgtcgttaacggttccggaaacggtgaaggtgtcgctggttgtggtgatttcgtaattgcctttgtcatcaacctgcagcgtatcagcttgcggcatattcagtgttgggaaaatggtgtcgaggtagatttgaagctcgccatacgcggtttgcgtcgtttttgagccatcagtggcaggggaagtcaatcgatagccgattgcttgttgctctgcggctttgaatggcacggtaaagctgaatttcccgtctgcaccaatcgtgaccgtcttcgcaggctcggtagcactggtgacggttaacgtcttgccggctggctgatcaacatgaccggtgatggttaattgacctgttttggcattgtagatgtcagccactttatcggcgccgaccaaggtgaaggaattgtcgttgaatttatcaaacgtcagcccttccgttggttgtgcgtgggtggtgatttgagaaaaggcacgaccacccaataccggagcgccactggttgttttcacattagccgcggctttggcgttatcctgcagcggtactgcaacgtgaggattttcttggctgaagtggccatagcctgagctgccgtcatcaaggaagacgaccatttcatctccgttggcgcgaccggcttgttcataggtgccaaaatccgctgtcggtgcgaggacggtgccgacaaagtcaccatatggagcggatgcggttaagttaaaggtgacattgccggttttagtatcgactttaccggagaagactttaccactcatggcatcggtcgcgtatacgatccaatcaacgccagctggaacctgagcataggccgtaaagctggtttggtcggacaccgcttgaacgaagccatctgtacgccagtggttgtatggaccatcgccaactttccagctgaactgcggtgccacattggcggttgttgctgttggcgttgttgcttggtgggtaccggtgacggcctgcagcgttttgctggttttattaccggcaacatcggttagcgtcagagttaaactgccatcgctgctttcaagtgcggctttttgggctgcggtgaggtcaaagctcaaggtgccatcgttattctggccgttgttattcaaactgacgccataagctttgccaccgatcttcaacgcgatgtcactgaacttggtgaagcctgcaccttgatcgttgtagttaacggtgacgcgaccgttttgatagctcaggcctgtcagggtcggggcaacggtatcaacggtgaccggcaagtcaaagtcctgattttgctgggcgccggcgttatattgttcggttaccagccgataagtgtatttgccgtctggtgcagtcacatatttgccagttgcttggtcataaaccttgccgtcccaagtgaaggcatttggatcgagacgcatatccgtgctcagtcctaagtcagagttgtagctattcccattttgcagataggacttggttgtgttgttttccttatccaacacgcgaaccacatggccttgtgcatctagaatctggatggtaacggacttgaggttctgcttggaaaatacatatggatagacggtgtcgctggcaccatcgccattgggtgaaaatgaaacctttttgttgtcgacgtaggttggaaccagtgtccaagtatacttgccggttgtatctgtgttcacgaggctgctgagtgacgctgagtcggtgacccctagtggtgtgttggcgccatcaaccaaatagccgccattaaaaatggactcgccactgttagcagacgcatcaaccacctgttctgtggtgagatcaaaggtgcatcttcaaggtaagcatggatatcttcacctttgtcgatgaagtatttatccggcacaccattgacgatgttgtcctgagtcggttcgttcaaatacgggaagtcttttggcatgatctcgttaaagatcgccttgccgacactcgtcaccataatcttttgtttctgctcatcagtaaacggtttgtccgtaaaggagttcgccgcaatcccgacacggctgtgcagatgaacatagccattttgcaacgccatcaacacttcattggtatccttgaagatcatgccttcgccttcgcggcccttctgctccatggtcaggtagtagttacctaacacaacgtcttgagaaggggtaacgattggcttgccgtctttaggtgccaaaatgtggtgagctgccagcatcagcatgcgcgcttctgccattgcttcatcagatagcggtacgtgaatcgccatctggtcaccatcaaagtcagcgttataagcttcgcagactagtgggtgcaagcgaatggacttaccatcaaccaagacaggttcaaatgcctgaatacccagtcgatgcaaagtaggcgcacggttcaaaaggactggccgttccttaatcacatcttcgaggacatcccagacatcatcatcttggcgatcaatcttccggcgagcatttttaatattgcttgccatatcgcgcttaaccagttcgcgcatgacaaatggcttaaagagttccaaggccatttcacgcggaacaccacactgataaaacttcaaccatgggccaacatcaataaccgaacggccagagtaatcgacacgcttacctaacaggttttgacggaatcggccttgcttccctttcaacatgtgggacaaggacttaagcgggcggttaccaggtccggtaaccgggcgtccgcgccgaccgttatcgatcaaggcatcgaccgcttcctgcagcatgcgcttttcgttttgcacgataatacttggtgcattgagatcaagcaaacgcttcagacggttgttacggttgatgacccggcgatacaagtcgtttagatcagaggtcgcaaaccggccgccttcaagctgaaccattggccgcaaatccggtggaataacaggaatcgtatccataaccatccatgccggatcattaccagactccttgaacgcatccaaaatgtccagacggcgaatcgcacgggtccgtttttgaccctgagctgatttcaggtcttcttttaattcagcaacttctttttcgagatcgacatcctgcaacaattccttgatggcttcagcacccatcttggcattgaaggtctgtccatattcttcccgcttttcgcgatattcgcgttcggttagcagctgctttttctccattggcgtatcgcctggatcaatcacaacataggaagcaaaatagatgatttcttcaagtgaacgcggcgacatgtcgagtaccagacccatccggctaggaattcccttgaagtaccagatgtgcgtcaccggtgcagctaattcaatatgacccatccgttcgcgccgaaccttggaccgggtgacttcaacgccgcagcgatcacaaacgattcccttatagcgaattcgcttgtacttaccacaggcacattcccagtctttggtcggtccgaagatacgttcatcgaataagccgtcccgctcaggctttagggtccgatagttgatcgtttcgggctttttgacttccccataagaccagctgcggatcttgtccggcgaggctaagccgatttgcatactttcaaacttattgacatcaatcaaagggctaacctcctatttcttatcgtcggtactattgtcggcagactgaccgtcacttgcttgggttgcggcttcgtgtgccttcttttcttcttgctgagctgcgaacttcgctaatgcatcgacagaaacaacatcgtcttcgtcatcgtccatgtcgcgcaattcgatttcctgcttatcagcacctagaaccttcatatcaagtcccagcgcttgcaattccttgaccagcacacggaatgattccggtacgccaggctttggaattggatcgcccttaacgatggcttcgtaggtcttaactcggccaacaacgtcatcggacttataagtcaagatttcctgtaaggtatacgctgcaccataagcttcaagggcccaacttccatttcaccaaaccgctggccaccaaactgagctttaccaccaagaggctgttgggtgactaagctgtaaggtccaattgaacgcgcatggatcttatcatcaaccatgtgagatagcttcatgtaatacatgacaccgacagatacccggttttcaaatggttccccggtacggccatcatacaagactgacttcccatcagatggcatgccggcttctttaacggttgcccacaagtctttatcgttggcaccgtcaaagactggcgttgcaacatgaatgcctaagttacgagcagccatgcccagatgcaattccagcacctgcccgatgttcatacgacttggcacacccattggcgacaagcaaatatcgactggggtaccatctggcaagtatggcatgtcttcttcaggcacaacgacggaaaaccgtccctttgttcccatgacgaccagccatcttgtcaccaacttgaattttccgcttctgcgtgatgtaaacccgtaccatcatgttgacgccaggagataattcatccccagcttcacgggtgaagattttgacgtcctgaataatgccgccgccaccatgcggaacccgcaacgatgtgtcgcgaacttcacgtgctttttcaccaaaaattgcgtgcagcagccgttcttcagcagataattccgtgactcccttaggcgttactttaccaaccagaatgtcaccatcccgaacttcagcaccgacacgaacaaccccgaattcatcgagatccttgagggcttcttcaccaacgtttggaatctcacgcgtgacttcttcaggtccaagtttggtatcacgtgcttctgattcatattcttcaatatggattgacgtgtaaacatcatctttaaccaaccgttcggacagcacaatcgcatcttcgtagttgtacatgttccatgtcatgaaggcaatgattgggttttgccccaatgccaattcaccattttgcatggctggtccatcagcaatgatttcatcgacatcgacatggtcaccgatcgtaacaatcggacgttggttgtagttcttgccggcgttactacgcttgaatttcatcaatttgtaagtgtccaaggcgccgtcttcacgacgtacccggatttgcttagcatcgacatattcaaccgtaccggcattgttagccaaaaccgcggttcctgagtcatgggcggctttgtattccatcccggtcccgacaagcggggcatgcggattgatcaaaggtaccgcctgacgctgcatgttagcacccatcaacgcacggttagagtcgtcgttttccaagaatggaatgcaggcagttgcgactgcgacaacctgcttaggcgaaacgtccatgtaatcgactttgtctggtgaaatttcaatgttgttatctttatgccgggccaaaaccgtgtcatcaacgaaagatccatcatcgtttagtggcgagtttgcctgcgcaacaatgtagttatcttcttcgtcagctgtcaggtaatcgatcttgtcggtaaccttatgcgtatcccatgaaacccgtcgatatggcgtttcaatgaagccgtatgggttaacgaccgcgtatgaagccaagctgttaatcagcccgatgttcgggccttcgggggtttcaatcggacacatccggccataatgggtgtaatgaacatctcgaacttcataacccgcacgatcacgagtcaagccaccaggtccaagggcagacagacgccgtttatgggttaattcgcccaacggattggtctgatccatgaactgtgacagctgggaactgccaaagaattcgcacaggttcgcgatgctttggaagaaaaagggtataaattcgtccaaaacgaattgacgatggtaccacaaaatctgaccccgattcctaaagataaagtcgaacaattccaagccatgatcgatcagctagaagacgatgatgatgtgcaggaagtctacacagccggcgactggccagacgattaatgagttgaataaatgagtgaagaggctgggctatcattcccagtttcaaactaaaggcgtactatttctcaaatttagcgagaaatggtacgcctttttgattctttacattagtatcaatggcatttaacgattttagcaccaaggcggagtaatctctggctagatggatggcgttgcatagctagggcggaaacagcgcggctaagggacagagtgtgagcatcttgagacataatggccgtatttttaatcaccgtgatcaatgtccttatgtgcaaacgatgacatccgcaaaagcgtgacgggtaaactttttaggttaatgacaaactcgtcctcaactgcgaattcttttaatgcaggaggaaagagtatgcagtcagtgaaaacgttattgaccaacgcattagccaaaggagccagcgatatttactatttgccaaatccgcacggttatctgattcggcttcggttaccgacagggttagtgactttagggcaactgggaacgcggataggtcagcaagagattaattatctgaaattcatggctgggatgaatgttgcagagcatcgccgtgtccagttaggcgcattttatcatccggactctgatgtttttctgcgtttaagctcggtggcagattttcggggccgcgaatcattggtggtgcgactgatcagtggtattccagatgcgcagggtgcacgtcagttgttggatcggttaatgagtattttgacgcaacgccgaggcatgttgacattagctggcccaaccggatcgggtaaaacaacgttactgtaccagcttgcaactcgcttggccgcctcgaaaatggtgctgtctatcgaggatcctgtcgaaattaatcagcctcagtttctgcaacttcaggttaacccagaagcggaaatgagttatccgcagttgttaaaggccgctttacgtcatcgcccggatgtattgctgattggtgaaatccgcgatcggcaaaccgcccagagcgcctgtgaagctgccattagcggacatattgtgcttgcgaccgtacacgcacgttcggccaacgacaccccactgagactgactagctgtggcttacctgccgaattggtttctgccgcct

SEQ ID NO: 402 - DNA, 9217 bp, Lactobacillus rhamnosus
  misc_feature (1)...(9217): n = A,T,C or G
agcaatgttgttggccagtaacaacgccgaaattgcgcattgtgccaacccgcttgccagataaaccgacgcaattaatgaccacgaaaagtcgaccacgttaaagacgttgacataaaccgcgatcggcaccaattggcccagtcctatttgtttgtggggccaaaaggagcagggaagttagcgctggctgagtggattgcgctgcgcctattttgccagcatgtccaagacggtgctccttgtggcgagtgtcctgagtgcgagcgcatcttaaaccataatcatccggatgtgatgatgctcaaaaccagtacgcaaagtatcaaggtggatgacattcgcaacttgaaacaggaaatgagcaaaaccggggttgaaggcaatcagcgcgtgtttattgtggaagatgctgataaaatgacggcaggagcggccaattcactgctaaaattttttgaagaaccggttctggggatgacggtgattttaacggcgacggctaagaatcagttattgccgacaattttatcgcgggcacaggtgattacttttcagagtccggatcgtaacgctgtgattaccaagctggaagaaggcggagccaattcgcagctggcgcgagtggcagggcgcttaaccggtaatgtcagtgaagcgcaggaactattggcgtcagatgattttcaggatcagagaccgattggatgacataaacatcagcaccacgaacactttccggcagctcgatttgaacttctccatcggcaaaatgattcactcgagcgggcgataacggtaaacccacttcggccgcaatcttttccgcgagtggtcgattgccattgagactgaataattttaattcgtgcatcgatttctccctttttcacatttaacggtttgcaatgttattatacgagataaatcgagaaattgcgactggttatgcaatgagttaaagtaataacagaatatttgcagattcataagcaaggcttcggcaagcgtccgctttagcatttgccatgctttgatccaactgcaagactaggaaatgggaggctctttatcatgaaacaaagccatttgatcggtcttgcaccccactgttgttgtcagcggccactttaccaactgttgagcgtttttaccaataatgcattttcggcgaatcaactacattcctgatgcccgtagctccatgcgaaaatacgcctcatcatattaccgtcatgtccactgggttgaaagtcagcggcatattgaagcctggcatatgacagctccggataatcagcggcttgaagcactttggctgccgcatcccggtagtcaaaaagcggtgattatcggtcatggttataagggcaccgggattaccatgagtaactttgcccacatgttttacgacttgggcttcaatgtgttgttgcctgacgatcgtggccatggtgaatccgatggcgagtacatcagttttggctggttggatcggcttgattaccttggctggctgcaacgcattcttgaccggcttggtaacgatgcccagttattgctgtttggcacgagcatgggtggcgccacggtttcactggtcgcaggcgagccgagtttgccaaaacaggtcaaggccgtaattgaagattgcgggtacacggatgttgaaacggaactggcttatcttttaaagaagcaattccaccttccaccgctgccactggtaccactagccagcttcatcaattatcggcgcttaggttatcctctccgcgtggtcaacgtccgtcaggctttaacgcgaaaccgcttgccattactagtcatccatggcgctgaagatgtttatgtgccaaccaaaatgggccgcgaaaattacgctgcctccgctggtcccaaagcgctctggattgtcccgggtgcggcccacgccgaaagttactggattaaccccgcggcctatcaagcgcacgtgaagcggtttttggatattttcttttagcgcttgcactcctaataatagtcgtcatgtggcagctacgtttcgttgccatttcctccgcgtagccttcaaactgcgcggtttttttaatctaaaaagactcagatcgcctctgagtctttttctatcgccggatgagcggctgctatgactgccacttccgcagactattcaaattcgttttcttcagcttgatcttgctgcttgcttaacgcatcaaacgtccgcagcatctccaagttcgtctcaatactttccggccattcccaatgttgaacattaaacacatgcttgaggtgtggccccgcacttgccggccatagcttcgttgtataggtgacgtgattagcatcgaacaccttcaacaaggcttggctttgcaagtaaaagctgtcattttgcccgccaatcagcataaacggcggcaggtccaaacccttgacaacctgcgagaaattcaggtgatcggccagtgcctgatcgccgccgcttaacttgtccagataaaacgcggccatatcgctcatgtcaccggctgcttcgggaagcttacttggttctgcgactggacaaaccagcgccaccagggtgaagttgaaattaacccgactcacgccaaagagttcctgtaactccgcactctgctggatgcaggcaaccaaggacgccaggtggccgccagctgaatccccggtcaaaagcacatggtcaaggtcaaatccgcgttgagggccaaaatgcgataaccagcgcagactagcaaagatgtcttgaatctggccgcgtaaatcaacatccggtaacaaccgatagcccatacccatcactgcgtatccttgactagccaaatagcggcaataattacgattcaaattacgatcaccataaaaccacccgccaccatgaatatcgatgacggtcggcatggttgcgttgcgtcttttggccggatagtacaggttcagggtttgctgcggatcagccgactgttcgtaccgatattccgtctcccaatgaacatcttccggtacccgttcatccgcgtaccgtgccttatcccgagcagccgtttgcgcccagctcgcttgaacctttgccaacattgcctcttcatctgccattaacgaatgcctccatttcctcgtgttaacgaatcgtgttaaaaggttattcctatattaacgcaaaaagactgccggtgcgtcacccgacagtctaatcgtttgattttaagcccgttttttaacgatccttggatttaacacttgcttcaacttcatcaatcaaagcagcatcttttaacccggttacttctttaatgacgtctactaatggctgatccttgagcatcgcctgaagtttgacggcttcggcatcattaggttcaacataatggaacatcatgccaaccgtatccatcaagacgctgtaatccaaaccgcgttccttcagttcccgaatcggccggatgaagcgttcgttgtagccaagcttacgaattggcgtccgggcaactcgcgaaatatcatcggaaatatacgggttctggaaccgttgcaagacccgattttgataagtctcaagttccttttcgtcaaagtttttgaattcagctaaaagcagtgaacgggtttcggcaagcgcacctttggcctgattaaagactttaggatccttgatggcttcaccgatcgtggtgtagcccaagtacttgccagtgtaagccgtagttgcgtggccagtgttgactgagaagagcttacgttcgatgtatggttcgagatcaggaacatagtcgacggtcttaagcttcagatcatggttcttcatctggctttcgtcaacaacccattctttgaagtcttcaacactaacggctaatggatcatcatgtttttgctgcgggacaatgcgatcaaccgctgcattagggaagccaacgtacgtatcagcaaaggtcttgccggcgtcatcaagatgttcataaacgctcttcttcagcgactgtgatccgccaatcatgttctcacacgcaatcacatctaatggttggtggttgttagcggccgcgcgtgcttgcaaaccttgagcaatcagcggcgcaatgatcgggagaatcttcgggccaatcgccgtcgtaaccaagtcggcttgggcaatagctttcacaactgcctcaggatccttggcgttattcaacccgtcaacattgtccacatgaattttcttttcacccggggcggccaaagtgatggtgtattccccacgctgatttaacgcattgataatcgtctcgttaacatcgacaaaattgattttgaatccattagcggcaagcgtttcaccgataaagccgcgaccaatattacctgcaccaaaatgtactgcttccatcatgatttattcaacttccttcagtaaattgacgatttcttccggcgtttgtgcgtcggccagtttttgaacattttcaacatcactacaataaagcgcaatttgtgagagtagtttgagatgctcgccgtttaatccggcaatgccgaacacaacggtcacgagattctcatcagccggatcatccgaccagtcaaccccccacggatattgaacgaccgagataccggtctttttaatatatttcatgccgtcttcagtgccatggggaattgcaataaagttacccatatacactgaaacgtcacgattacgatcaatcattgaatcaatataacccggttcaacgttgccattgtcgaccaagagctggccggcctgacgaatggcttcttccctggtcttggcttcttgaccaagtttgatcgtctttacatcaagtcctttcatcatgtcaccttcgatcaattttttgaatttcgtgcataaagacttctgtcatcacttgatataactgactatagtggcctttttcaaaaagctgtatgtccgctggtgaggcaactagcttggcgctaactgcactcaggagggtcaatgtttcttgtggaacaggattcggcgtcagcaacaggagaatccgctgcagttggatcgtgcccatgtccattgccgctaaaggtatcgctgttttgagatcaaacgccccgatatatggggttgtgacaccgcgactactcgtgtgaatcattgctaaacctgtattcgggatgccaaccggcgctaattccaatctttttaacagtgcttctttgacaattggcggttcaacgacaacggtcggtaactgggcaagcatcgcatcgatagcagcagcaatcgtggtggccggctcattcaagtcgttgacggcaaagtgttgtaatagcccatctgctgccatcaccatggtttttaggctctcaaaggcggtaactgtttggtccagtgacggttgattcaacggccgcacttgtttaggtgtggcgcgctgaacaagccggcgcacttccgctatttcctcgcgtcccaatatcggcgtaatcaccaagtactgatgcttaaaccccggcagcggcatggtagcaaggaccagatcgtaatattcaagttgttgttccggtaaatcactcacctgaacaatcttaatcttacggatttccggtacctgcacacgcaactttccagcaatcaagctgccggttccgggtccatcactagtaaccaatagcaccgcaacgggcttttctgctggcgcgtgatccaaaaccgaagcgaagtataaaaccagataggccagcgcatcgccagtgaaggctccttggccgaaaacatgatcagctgccttttgaaccgcttggtaaagttcaggataatcatcttgcaaatgagcaagtacgggattggtcattgtgacaccagacagccaatcccctccagccgttcgttggacatgagccagtaatgaggaataaagctgtgtgttcccggaaaatttcccgggaaatgatcgggctacttcccgaataagatcctgaacttcaaggttgatggttaaatcaaattgatcaaccggttcgcctgccaacccgccgcgaatattactcagttcgatggcaaggaattgataatcaccgacacggactttttcgcggattgtcgaatccatctcggctagaaattgtagcgccagttgttgatcctgaaacagtcgttcctgatcaaaatgctgctgcggtttaacgtgatggtcctcacgcaatcttcgtgtattaattgcaaccgttagtagcactgctttacgttgattgtcatttagatccgctaaagctttaatctgagacagtgcggtgttagcagcaagtaattcttcttgcggtaaccgttcaatgaaatagttcgtcaccggatcaaagtcttgctgcggatcgtttaggaagcgaaagaacacatacggattaatttcagcattcaagacgccgaccagaacccggcgaatatcaccttcttgtccttcaatccagataccagctgctttttgccgattcagcttgagatgatattcatttaacgccggttcgagaatatccagatcttgcttaatcgtcgtaatactgacatctaccgcatcagctaaggctgtcatcgtcaaagtttcatccgttgtcagcaacatcagtgttagtgcactctgcctctgactgggatcaaaggtgagatcttgccgttgatgtgacaaggctgcagatagactggctaaatcagcggctgctcccacaatccggtatgagctgccattgcctttgtccaatttcaaattcaccgttgcgatatcatgctccagttgcgaaagctcacggtaaatggtccggcggctgacgcccagctgtcgctccagctcgtcgcggcttatgccggcgggctgactcatcatcagtctgatcatttcctgttcacgattcgttagtaacatgtttttcgccccagacggccgcaactcgacctcgcttatttcaatttctcaataagtttatcatagttcgtcgcgttcaaaagaccatccacggtatagacttgaacattggcaaattgtaatttaacacgccgggcagtttctttcgatgcgatgattaagacatgatccttatcatcaatctcaccgatcgcaacattacgaaccttgacgtctttgttgagttttcgcaactcagagcggaatgtcgcttgcgccatagttgccgagccgatattttgatcatgatgcaggaagtctacttctgtaatcttatcgaagtcgatatcgttaagctcgtcttctggcgtttcctgcttagcttttggcgtttctttggttgtggtttcatctgtcccgccaactgcttcagccttcaaactagcaatgatctcatcatacttaggactattcaagaagttctcaacagcgacgtgtgctgcatcaggtgtttgtttcttagcccgatcagccaattcttcttgcgtcacaactaagagtcccggtttatcctgcaagttgctaatggccgtgttggtaaccgacagatccaaaccagcctttttgactttatcgcgcagaattgaagcacccatagcactggagcccatgccggcatcgcaagcaaagataatttgcttaatgcctttagcctggctcatgacatctttagcagcagccacatcctgacctttagcttcagctttcatcgacttcatcttcgcttcactggctgccaactcatcgccagtacccttatcgcggcgcaagatgaatgccgaaatcaggaaggaaacggcagtgggcaccagtaaccccaacgattaagccgatatagtttccgatatcaaccggtgacatcgcgagcaacgataggatggagccgggagatggcgaactctttaagccaacattgaagattgagaacaaggtcgtcccagtcacaccaccagccataactgacaggaacaatgccggtttcattagaacatatgggaagtaaatttcgtgaatcccacctaagaaatgaatgatgatggctgaaggtgcagaacctttggccgcacccttaccgaataaggcaaatgcaagcaggacaccaagccccggacccggatcaggttcaagcaggaacaggatggacttaccatgttcggctgctgcctgaatcccaagcggtgttaagatcccttgattgatcgcattatttagaaacaggatcttagctggttcaataaaaatatttgctaaccataacagaccatgattgataatccaatcaacgccggctgccattgcgttagtcaagccggaaatgatcggtcccattaagaagaagccaacaattgctaatagcatcccgataatgccggcactgaagttattgaccagcatttcaaaaccttggcgaatcttgtcttggacccgatcgtcccatttcttaatacaccagccgcctagtgggcccatcaccattgccccaatgaacattgggacattggttccgacaataacccccattgcagcaatggcgccaacaacgccgccacggtgacctgctaccattgaaccgccggaaaaagcgatgagcaatggcaataggtaagtgaccattggcgtgatcatttttgccagttgcgcatttggcagccagccacctttaaggaagatggcagtaatgaggccccaagcaataaaggcgccgatgttaggtaacaccatgccggaaagcttggtcccgaatgattgcataccggccttcagattgaatttcttcttctctgttgccggcgtgtttgctgatttagcttccaaagcaaacactctcctttcgcttgtttacgaagattattgtaaccgctttatgtaatcgctgacaaaagctactttggcacagttagttgtgccaaatattcagcatcaatcccatcagcactatttgtgggtcaaaataatacgtatcagatagtaacagtattcgttatctgtttcacaagttatctaaacctcgacgctgttggtcgccttcaattaagccatgtggattgctttttgaaaaagaaaaatcagtttctaccatataaataaggaacatctcagtgctatttcagctgccagcgttaatcataaagccacgctccttcgtgattcggtttacaatgtgacggcgatttagtcacagcgccggatttttaaaagaattcgattgcnagcttctagcgacttcagttnntcnncnancggnncttcaatccctnnnnccccgc

SEQ ID NO: 403 - DNA, 1753 bp, Lactobacillus rhamnosus
agtccaaccgctgcgatgggtgtcggctatggattaacgtcagttttaggacttttcctcaatgatacctgggtctttaaggttaaagatcaccgcgaccttaaaagtgtggcaccacgatactatttttcgtatggtctcacctttatcatgagcctgatactcacaagcttctggaatgatgcattgaatttaccaaaaccattagcaccgatgtttgcacttatgattaccgtcccaacgaacttccttttaagtaagttctgggtatttcgagaaaagggagttacggcacatgaaaaaaattaaacagtggacccttgattggtggctcattggcattctcgttctggctgcgtttctttacagctggaatatctgggaagcaggaaacgctaatgattattacacggctgctatcaccagtatgatccaaagttggcacaatttctggtacggcgcatttgatcctgctggctttatcaccgttgacaaaccaccggtagcgctttggttcatggccatttccgccaaaattttcggcgttcacggctggtcagttgttttaccctcaattttgtttggcgtcggcagcgtggcgctaatctataacatgatcaaaccccgctttaatgtttgggccgcccgcttagctgcattggcactcaccttaacgcctatcgttgtcgcggattcccgaacaaataacatggacgccacactacagttctttctgctactcgccagctggtgcctgatgaaagcaatcaccaaccgcaagccttggctggtcatcatgagctttgctttgatcggggtttcgttcaacattaaaatgctccaagcgttcatgattttgccagccttattactctttttctggcttgcatcaaagcagcagttatggcgccgactggctacactggggattgcattagccgcgatggctgtcatgacacttgcctggccactacaggtggactcaaccgccgccagccagcggccctatgtcggcagttcccaaacgaattcagaaatggagctggcttttggctataacggtactgaacgattattgggccaaacaaccggtaccgggtgcggccttccccggtatgggcaacagcaagaccaaagcaactggtgaaatgaacccgacatccggggcgaccaaaggcaataatagcaaaaccggcacggcaccgactggcactaaaggaaatccaccaaccggcacaaagggcacaaagggcacaaccggtacgccacctggcggaaatggtggtggtcgcccaggtaatggtcaaggtcagggcggcacgccgccagctggaaccaacggcaaacaacctactgtgaaaaccaaatccggcacatctacaaataacgcacctgcaaactttgcagagggcaactttaaaggcggccgtggtactggtggtggtgcagctggcggtcgcggcggtggtgcagctggcggtcgcggtggtggtgccttttcaattgggaatgccgggccactgcgcctgctgcaatctgatcttggcaaccggtggccctggcatggttaagtcagcttattcatccggcaaaccggccttgggtgttggcgcagggaatgcaccggcatacatcgaagcaagtgccaatattaagcaagccgttaatgatttggtcttgtccaagagttttgatcccggtatgatccactagtgtcgactgcaagcgcctaccaaagtttctatcgcccggc

SEQ ID NO: 404 - DNA, 6249 bp, Lactobacillus rhamnosus
tcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttactttgccacagcagccaaaatcgtcttaatatctgcaaacactttatcgatgtcttgatcaccattaacagtgtggagcaaacccttcttttgatagaagtctaataatggcgtattcatctcgatgtttactttaagacggtttttaacggtttccggcttatcatcttcacgttggaagaattcgtggccgccacagcgatcacatgtgccggcaacctttggcgggttgtagattttgtgataagttgcaccacatgtcttacagataaaccgaccagacaagcggtcaactaactttgcaggcgcaacatcaatattgataacagcatctaacggcttcttaagatcagctgtgatcgtttcgagtgcctctgcttgttggatggtgcgcggaaagccgtcaagcatgtagcccgcatcggtatcggactcagcaaggcgttccttgacaatgccattggtaaccgagtcgggtaccagttgacctttatcaataaagccctttgcttccttacctaatgctgtgccagcagccatcgcggctcggaacatatctccggtggaaatatgtgctatcggataagtatcctcaatccgttctgcctgcgtgcctttccctgcaccgggaagtcccattaaaatgagattcacgttgcatcctcctctaattgtacgcgctggcatgtatttaaaactgctgtgaacagcttctaaacgatttaacgctgaaacttgccagtttgtacgctgcttttaacgcgtcaaccattgaaaatggctgacttctgatatcgtttacttcttatcgttcttaaccaaatcaccgcgaataaatccgacgtactcacgcttcatgagtaagccgtccaattggcgaaccaattcaatagcggtcatgacaacaatcaacaggctcgtaccaccaagtccgattgattgcggcaacccccaaatgttggcagccagttgtggcagtaaggcaaccaaaccaaggaacaaagcacccactgttgataagcgcatgagtagccgtgagatataattctcggtttccttacccggccaaacaccgggaatatagctgccttgtttggttaagttttctgcgaccttctcgggattaacctgaacgaacgcatagaagaacgtgaacagaataatcaaaagcgtatagatcgcagttccggctggcttttgcatattgaagacattggtcatgacttgataccatccgtcagtcccatgattcttctgaaaagccattaaaattgtttgcggcgtcacaataaaggaactcgcaaaaataaccgggataacaccggcaacgttaactttaagcggtaggtaactgttactgcccgcgctggtaacgcgccgagtgtactgaattggaattttgtaattagcttgctgcacccaggtgacaaatgtgataaccaggatcacgatgactgccaaagctgctaaaaacgcaattcctttccagatttcagaaccagagtatacctgaacgttatcccgatataactcctggagacctgaaggcaggcgtgccacaatcccggagaagatcaacagcgaaaccccattaccaaggcctttatcagtgatctgttcacccatccacgtcagcaacattgtgccgcctgtaaggatgataccgattgtgatataggtactaacggacggatttttaaccaagcccatcgaacttaacgtttgaaagccggccgtaatcccaattgcctgaaagaacccaaaagcgatagtcagataacgagtaacttgattcagcttacgccgaccgacttccccttgcttgctccactcgacaaatttcggaacgatatccatctgcagcagctgaaccacaatttgggccgtaatatacggcgaaacccccatcgaaaagatggagtattgtgccaatccgccaccactgacagtatccagcagtgagatcaagcctgtcgagccgattgactgcagcgccttggcattaacaccgggaactgcaatcagtgtacctaatcgatagaccaataaaaccgctaaagtgaagaggatcttgttacggatgtctttgaccttgagcgcgttttttagggtcctcagcattagatcacctcaatcgaaccgccagctgcttcaacggcagcttttgctgcggttgaagcttttgcaaccttaatggtcaattttttctcaagtttaccgtctgccagcaacttaacaccgttcttttcgttcttaacaatcccggcatcgatcaaggcagctggtgtaacttcagcaccgttatcgaagcgattaagatcggaaaggttaacgattgcatattctttgcggttaatgttgttgaaaccgcgctttggcatccggcggaataatggcatctggccaccttcgaagccaagacgtgtcttgccgccttgtcgtgccaattgaccttttgtccctttaccagctgtcttaccttgaccgctagaagtaccacggcccagacgcttgcgggcatgacgggagccgacactcggctttaattcgtgcaattgcatactcttgggcacctccttgtcgaaataatgtattaatctttgatttcttcaaccgaaaccaagtgtgaaatctggaaaatcgcaccacgagtggctgcgttgtctggtttaatcaccgagctgttcacccgatttaagcctaattccttcacaattttacgttgcttaggaagacggtgggcagcactacgggtcaaagtaatcttcaattgagccatgtgtttacctcctagtcttcaagcgatgacgcagaaacgccgcgtaattcagcaacttgttcgcgggtgcgcaactgtgtaagtccatccattgttgcccgaatcatattgattggcgtgttacggccaagggatttgctggtgatatcagcaattccggcaagttccataacggaacggatagcgccaccagcagcaaccccagaaccttcttcagcaggcttcagcaaaacttcaccagcgccgaagtggccgattacttcatgaggaatcgtggtgccgacaattggcacttcaatgaggctcttcttagctgcgtcaacagctttacggattgcttcaggtacttcttgggctttgccggttgcgaagccgacgtgaccgttcttatcgccaacgattgcaattgctgcaaaccgtagacggcgaccacctttaacaacctttgtaacccggttgatggcaacgacctggtcttctaagtccaattggtttggatcgataaatgatgccatgtgttggttatcctccttttttctagaattcgaggccattttcacgtgctgcttcagctaaagcggcaacgcgaccatggtacagataaccaccacggtcaaagaccacaactttatgaccatctgcaactgcgcgcttggcgatcaatgcgccaacctgagcagccgcgtcagtcttgttttcaggatctttaatgtccttatcaagagtggaggcacttgctagcgtcacacccgctacgtcatcaattaattgcgcgtagatgtttttattggaacggaaaacgttcaagcgtgggcgctcgctcgtaccagaaatcttgcctcgtacgcgggcgtgacgccgttgccgagtcttattcttatctggctttgaaatcacaatgttcacctcttgttaaatttgttgaaggttacgactacttaccagtcttaccttccttacgacggacatgttcgtcaacataacgaatacctttacccttataaggttcaggtgcacggacggaacgaacaacggctgcgaattgaccaacaacctgttttgagatcccactgatgatgatctgagtggtgcttgggacttcaacagtaacaccttttggcgcgggcatttcaactggatgtgagttaccgacgttcaaaacaagtttttcgccttgcttctgcgcacggtatccaacaccaaccagcttcatttctttcttatagccttcggtaaccccaacgaccatgttgtttaagttggcacgcatcgtaccatggatggccttgtaagaatcatcgggacgggtgaaattaatttcgtcgccttcctgatgtaattcgatttccggggcaaaatgacgggtcaattcgcctttagggcccttaaccgtaatattgtcaccatctttggtaacagtaacaccggctgggactttgatgactttataaccaatacgactcacttatcggcacctcctttttgatgttatgaattaccaaacgtaagcgagtacttcgccgccaacgtttttggcacgagcttccttatcggtgataacaccttcggaagttgagataattgcaatccctaaaccgtttaaaaccttaggaacagcatcactcttaacgtatgagcgcaaacccggtttggaaatccgcttcaagccggaaataacccgttcattgttcttaccatacttcaagaaaatgcggatcccaccgtgcttgtcatcatcgataacttcgtagtcacggatgaacccttcacgtttaagaatctcagaaatgtctttcttcatctttgatgcaggtacgaccaaggattcgtgacgcaccatattagcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgatatacggaatgcggacggccacaccgttggcaccgcgtatattcctggactgcaaattttgcaggccgtttgtttttagcgatcattgacttcttagccaagtagcggacctcccttatttggcgaatggcatcccgacttgcgtgagcaactcgagtgcctcttcatcagtatttgccgttgtaacaatcacaacatccaacccacgaacccgattaaccttatcgtaatcgatttctgggaagatcagttgttctctaacacccaatgtatagttcccgcggccatcgaaggacttaggggaaataccgtggaagtcacgaacacgcggcagggaaacattgatcagcttatctaagaaatcatacatgcgttcgccgcgcaatgttaccttggcgccgattggcataccttcacgtaagcggaaaccggcaatactcttcttggccttggtgatcagcggatgctggccagagattagcgtcaattcttctaccgcttcatccaataacttagcattctgagttgcatcaccaacacccatgttcaaaacgatcttttcaatcttaggtgcctgcatggtgctcttatagttgaacttgcttaccaatgcaggggcgatttctttgctataacgttcttcaagacgattctccatgaaaaagtttgtcctccttccctattatttatcgattgcggtgccagacttcttagcaatccgcactttattgccatctttaacttcagaaccgatgcgagtcggcttgttggtttcaggatcccgcgctttgccattaaaaccaaaaagaatgggacgtatacgtttgcagcgaaagatcctaagcgggttttacgtgccattcgggtgcacattcccgccgagcgaattgttaagtcgttaactttctggcaagtcgtaaagcgcgcctttacacgcaagaagtagcaacgatcccaggcgtataagacaaaaagacagctcacaggacttcttttttgaaggctgtgagctgtttttttatggagcggtttattttcactgctggaaatcagcaagcgccggttactttgttttgaagtttttgaacaactcattgatcgattcgtattctgcatcccgtagatcgacatcgagcgctttagcattgctggcagcttgttctggcaggcgggcaccggggatgacaacggcaatgtcggggttcttcatgtaccaagcgagcataatctgcgcaatcgttgcttgatgtgcatccgcaatgccgtcaacttcgcgaagtgcggctaaaatttcttt

SEQ ID NO: 405 - DNA, 12023 bp, Lactobacillus rhamnosus
gcgatttttgtttaatttggctggattattgaattgctgaatcgcattaatcgttaaaatctgcaggtcgtatttttgctttaacgtctgaaattctgcaacctgcatgccatcaatgacagtctctgagccatcagaagtggtcatatcattgcgtaactcgacttgatgaatgccagcagcttcggctaattgaaaaaagttttccagtggccgcttctgagcaatttttcgattcaaagccatttgtgtcagttctatccccatcacgactcccccacttctcttcgcctacccaaacaatctgcgacttagtgtgatcgcaattatggcgtcaactaaagcagttgcccgccaccgatacagacgcctcggtgcagcaacctgcacatatacgaactttgagcaccatgaccaaacgcctctatgctcccgtttctgaccacaccgactcgcgttcacaaaaataccttggtcgattcctctggcaaagttccagaagcggccaaggcatcctgctttacttgatattctctttataaactgccatccaaaaattgggctttgccttgaccaaaactccagccttgatcatgattaaacgaaacattgaccatgagatcgttcttatccactaatcccgcttcggataagcgccttgccaaactttcataaaactgctctaattggtgaaccgtacgaacgcgactcactaacgaaatcacaaccacctgatccgttcgtggtatgcccaacccggtatcctcaaccaccatttcatatggctcatgttggtggacaatttgataacgatcacgctcgggtacctcaaacgctgcaaccatcacttcatgggtgatttgcaaaatagctttaatagtctcgggtgaccgcccttttaacatgtcaaatcgaactaatggcatcgttccccctcctcatacgcagcggtaactgacaatcagtattcttattagactatgaccgacatgagccaattcaatcgccatgtgaccggacaattattcaaaggtcactgagcgtttactctttccaagaatatgaaatgccttcattttggtttcaactaattgcgcaatcgcctttttgcctgccaaaagaatcggttgcggatcatgaccggaacgtttggcttgcaccgcttttgtgatagctgcagtccacaccgtgttcacttctgtattgatattgatcttagccgttccggtttggatcgcctgttgaatctgatcatcaggaatgccagatgcaccatgcaaaacgagtggtaacttggtagcggcggcaatagcagccatccgttcaaagttcagattcggacggcccacataatcgccatgaaccgatcccaatgctgcagctagggcatcgatcccggttgcggccattttaacggcatcggtgacactagcataacggatgccattgattaagccattttcattgccaccgacactgccgacttctgcttcaaccgaaacatgatgctggtgcgcataacgaactacttcgtcggttaaagccacgttttcttcaatgggcagcttagagccatcaaacataacagaggtatatcccgcatcaatagcctgataaacatgttcaactgacaagccgtggtccagatgcaatacgaccggtgcggtgatgtgcaatgcctgcaccataaagcgtacatagccggcaatgaaatcgaatccgccaagaaaatcaataattcgatcagaggtagcaacaataatcggcgttccggttttctgcgcaactttaagatacgtttccaaccaatcggcaccattaatattaaagtgaccgattgctgcgtgatctgccagtgcagcttgaatcagttttgttgccggtatcaacgccataaaaccatatcccttctcaaacagaacccttaaactgcttggggaatcgtcatgatcgtatctagataatgcttagcctttagcgcatattcaaatggatttgcttttgctggatcttgttcagcttcaaccacaatccagccgtcatagtgttgcttttgaatggcttcccaaatcggcttgaagtcaatcatgccatcgccaggcacggtaaacatgccatttttaacgccttgaaggaagcttaagtggtcagtacgttcttgctgggcttgttcaggacgaacatccttgaagtgaatatgcttaatccgatcatagtagcgatcaaaaattgttaatgggtcctcaccggataacaccaaatgtccggtatcaaacaaaagagacactttatccggatctgtcatggccattaatttatcaatttctgccgttgtttgaaccccggtacccatatgatgatggtaaacaatctgcatcccgacttcatgggcgcgatcccccaaccgttccaaaccagtggccaagcgttgccactcttcatcggtaaaatgcggtttatcatcaaagaccgacttatccaacatgccttgaacactatggccttgttctgctaccacgattaccttggcccccatggcgtgtagaaaatcacgatgcttgataaacgctgcttcggtttcttcatagggcttggtcgttaaaaaggcgctaaaccaggcactagcaattttcaggtgtcgcagatccaagtaatgctttaaaaccactggatctttaggatatttattcccgacttccgttccttgataccctgccagcgccatctcatcaatggcctgttcgaacgtcacttctttgcccaagtcgggcatgtcatcattcgtccagccaatcggggcaattcctaatgcaatcgtcactttaagcacctacctttttatcaacatcggtaaccttgacaatatcgttcttttcgtacgcgcgttgcagtgccagcgcggctttggtccctcgaaggccatcttccgccgtaatgccgactgtctcaccagtcaaaatactgtcgacaaaagcctgttcttcacttaagaatgcctgggcaaaacgctctgggaagttttgtgaggttggccgaatgatgccttcttcattcatgaccgtcaccagattcttctcaggcacttgcgcaacccgcagcatgcccttggttccgataatctccgtttcgacatgatagccatgagcagcgttgcgtccggctactaagatcgccatcgtcttatcctcaagttgcatcagtgcagcacctgtctcaagctcgcctgcctgatccaaaaccggataggcgcgatttaagccgatagcccagactttatcaatttccttaccggtcaaccagcgaataacgtcaatatcatgaatcgacatatccaggaacaagccaccgctattggctgaagttgcgaacttgacaaaactttccatcccggctgcagggtcaatactgtaactgcgaataagcgtgatatcaccaattttgcctgcatcaactaattgcttggcataaacatatgaatcatcaaagcgccgcataaatccaagttggaattttaactccgggtgatcggcaatcactgcctgagtgtgtttaatggcatccagatctaacccaatcggcttttcactgaaaacatgcttgcctgcttgcatggcactttctatttgcggcaaatgaaacccagacggtgacacgataaagacagcgtcaatatcggcatgttgaaccatgtcatcaaagtcttcataggtttcttcaactccgagttcttgacgtgcccaggctaactcctccggtaccacactcgttgccgcttgcaacttagcatgtggaatcttcgtggctagattggttgcatggattttaccaagtcgtcctaaccccacaatgccaattttaacttccctttgaaccatcgcgttttccccctcttttttacattgcttgactagatggctaagcctttaccggttgattcgtttgataaaatgttggcgtctcggcaacattgatcaaaaccggttcttgatccttttgcgaacgaatcgcggcctcggccgtcaccgctgcaacatacccatcccaagcactcgggccgaccggtgactgatccttagccacgtgatcgataaattcctgaacttcggtgttgtacgcttgcaagaagcggtttacccaacttgtttccatagcggtttgctgagttgcttgggtgcgaacgattggctcgaatccgtaatccggtagctttaattctccggtttcgccgacaacttcgagtttgacttcataaccgtactgcgccgtcacatgaaccaacacttgaatgaccgttccttttttggtggtcaatgtggctaattgcggatcccgcaacccttcattggtcacctgacttgactggcgcggataggtgatttgaatcgatgcataatcatcatcaagtaaccaatgcatttcatcgatttcatgaatcaatgtatccgtaatggccatttcattggaataattggccgcaacattaggattaatatgactggcgcgcacaaccaacggcgttccgatgatgcccgaatccagcttagtcttcaaggcatggataccctcatcataccggcgcataaagcctacttgaatgacttttcgcggtttgcctatttccttatccacgatccgtttagctccctcaagggtcgttgccaacggtttttcggtgaaaatgaatttatcggtgtctaaggctttgagaatagtcgcctcatgtgcaccgccaaaactaacaacaaaaacggcatcaatgtccggatcctttaacaaactcgtgtcatccggataaacctttgcgttaagcttaaagtcccgaacagcggcttgggcagcttcttgatcaatatccgtgacggcaatgacttcagctccggttaaaacattggttagccgatcaatgtgtgcacgtcccattgcgcccgtaccgataaccccaactttgacaaccatgtcaatcgctcctttgtattgttgttttcctcagtatttaaatgcctgatcaatacctgtctgaatgtcttgatacgctttttggacgtttggattgtcggatacctcggaaacccccactcgccaccaactttggccgtatccttgtgtcatcgttttaggcagcactttaatatcaattaatgtcgaaactgtttgcttcttggcatcctccaaggcagcgactaaactgtcacgatcattgacgtgataagttttagccccatatccttccgcaattttggcaaaatcgattgttaaaatatcatggtcggcagttctaaattcggttcgatagctgttgctgccttgagccatttgtaagttattgatggaagcaaatccggaattatcaaagactaaaatgttgatcttcttatgatattgcagcgcggtgacaagttctgaatgcaacatgatgaagctgccgtcaccaaccaaggcataactttctttatccggttgtgccaacttaatccccaatgctgccggaacctcgtaacccatcatggaatacccatattccatgtgataggtattgggtacaactggatcccagattcgttgaacatcccctggcaacgatcccgctgcagcaacaataatgctatccggcgcaatcgtgtcattcacagcaataaccgcttccgtctgagtgaaatgggtttgtaacttctcggcatactcagctaatgttgccgcactgaattgacccttaacctcaggcgtataatctggcgcatcatagtttgtatgggccaaacgctgccgttcctgttgccaagcagctttgaggtctgcgaggttggtaaagtcactttgatatccggacaattcactagtcagttgggtcagtgtatcccggacatctgccacaatcggaaagccgtcaaacttatacgactgcatgcgattcaaattaatgttaagcacgcgggttttctccggatgaatagccgtcttggaagctgttgtaaagtctgtatagcgagttccagcaccaataatgagatccgcttttgcgaccacttcattagccgctgctgttcctagaatcccggtaccgcccatattattggcaaacgttgccgaaatagtggacttgccagttggtgtttcaacaatcggaatatttagcttatccgagaaagcttcaattgccgaaccggcttcactgaacttggcgccaccacccacaattaagacaggatagcgactggccttaatgagttgaaccgcttccgttacttccgccgcgctcggttgaatccgcttgatcacatgcacgcgcttattaaagaaactacgcggataatcataagcttcaccctcggtatcttgtggcaacgcaatcgtgaccggacccgctgtttcaggatttgtcagtacttcaaaggcttttaaaagtgcgctcatcagctgctcaggccgttcgatgcgatcccagtaccgcgacaccggcttcaacgcatcgttcgtggtagtagttgcgctgctatccacttcaatttgctgcaaaaccggatccggttgacgtgtggcaaatgtatccgcgggcaaaaagagaatcggaatgttgttcacgtatgcatttcccgccgccgtgacaaagttagccgaacccggacctgccgaagcagtcaccgcaaaaatcttatggcgatacaactgacggctataggcaatcgcagtgctggccattccttgttcgttatgcccttgataaacctttaagtgccccgggtcttcctgcaaggcttcccccaaacccagtacattgccatggccaaaaattgcaaagatcccttcgacaaacggggtgacctcaccatcaacatcaagatattgttggtttaaaaagcgcacgagggcctgcgcggttgtcaatcgaactgtatctgccgcggctgactctgcttctcgtccttgcgacttcaactccattgcgctcatcctaatgcacctcctgcctctctgcttcgtgaataaatgccgtgagtttcgccaaatccggcatcgcttctgaagaacttaattgactaatcacaatagacgctgcagcactgccatacttcaaggcagtttctattcccaagtcgtggctgtaagcatataggaacccggcagcaaatgaatcgccagcgccgaaactcttaagaaccttcgtcttgaaaactccaaaatgataatgatcgccggcttttgtatacgcatttgacccttgaaccccgcttttgatgacaattagcttaggatcatatttgaaaagtgtcgcaattgtctgctcgttcgtgttaccgtgatgattttccagaacatcaaattcgtcacgcgtgccaataatcacatctgcacgctgggcaactaattgataataaagactcgtttcctcggcatttttccaggtatacgggcgataatccagttcaaacaccacttcaaccccaagtgactttgcaactgtgagtgcctttaaaatcgcctctcgcgacgggctttgggctaatccggtcccggaaatcaccaacatcttggcttgcgctaaatattcttctgaaacatcagccgttgtcagatataaatcggcggcttcatttcgatacatcaaaatatcgctttcttcaggactaatgatttcagtaaacgttaagccaattttgtggcccgcatcatccttgaccatttgcgttgtgtcaatgccaacgtctgccatgtattgcgtcacataatgacccagctgatcatcggacaccttcccgatgaatcctactttttggcctaatttggctgacccgattgcaatatttgccggcgatccgccaacgaattttgcaaagctcttagtttcttctaaaggtcgattatattcaaccgcatttaaatcaactgctgctcgaccaatagcaatcaaatcgaatttttgtgacatttgaaatgttccccctcgtcaacttagctgcaaagctatcctttttcattactttcgatcaataatccaggcatgttctggcgcattgtgaaaatgccaaactcgtatcggtcccgccataatgttgaggtaataactgtcatacccatccggcacaccaacaggatgatagcctttaggaacaatcacaacgtcttggttttgcactgccatcgtctcgttaagcgataagtcatcggtatacacccgctgaaaaacaaatccttgcttcggctgcatttcgtgataatagatttcttccaacagcgattctgtcggtaaattatcgtgatcatgtcgatgtggcgggtaactggaccagtttccggagtccgtgtaaacctcgaccagcaataacttatccgcaaatgggagatcatccggcaagatgttttgaaccagacgcttattttgatacctgccgcgatgttcgatttgatgaatatcgcccttaatcaaccgaaccggaaatgaagtcgtggtcggcgagtatgcaatcagaaccttcgcggtagtttgtgcggcaagcttaaaggataagcccgttccaacataaacactgtctgtcggaattttgtcaaagactgattgccgttgaccgataccttcaaaacgctgatcaccggcagtgacggtcactttacccgccagaataacaataccggcctcgaagttacctaaagtctcggcaaatgaacgttgcgcatcaagctccaagactttcactgcggtgtatttcatgggagaattcgttgcattgacgtcttgaatcaaatgaacgcccggctgtatttcctgattttgctttggatacaacaagctcatcgttaatgcctcctcgtcaaacatctggaatttctaattaaaacgatgctggtcatatcttgccgtcacaaccttcttatgcgtgtagaagtccacactatccttgccgttagcgtgtaaggtgccaaagaatgaatgtttccagccagaaaatgggaagacagcaatcggtgccagaacgcccaagttaatacccagcatgcccgcatcaatattttctctgaagtagcgaatagatgcggccgaatccgtaaacaggcaagcgccattggctagttcggactgattggcaatggcaaccgcttccggtaaatcttttgcacgcatcacggacagtaccggggcaaacatctcatcgtgccaaatggtcatgtcggttttgacatcttcaaaaatagttggcccaacgaaataaccatcacgcttctcggcttctgctgacccgtctaagaccagcttggcgccttccttaaccccggtcttgatatagttcaacgtccgttcctgattctcctgacgaatcactggtccaaggaaaacatctttatccagaccattaccgattttgatgtctttagctgcctgcgtaaatttcgccataaacttgtcagcaatactttcttccagcaccaaaaccgacgtcgccatgcagcgttcgccggcggatccaaatgacgaactgataatgcctttaactgcagcatcgagatcagcatcggctaaaacgatcgtgtgattcttagcgccagttaatgcctggacgcgcttcaaatgatcactgccgcgcttatagacatattcgccaactcgttcggatcccacgaaactaattgccttgacatcgggatgatccaacagaccgttgacgacatcgtccgccccgttgacgatgttcaaaacgccatcgggcagaccagcttcttggaataactcaaccagacgctggctggtaagcggtgtcttttctgacggtttcaacacaaacgtattacctgttgcaaccgccatcgggaacatccaacacggaaccatcattggaaaattaaacggggtaatcccgccaacaacaccgatgggataacgataattcgtggcctcaacatcagtcgcaaccgccgagagcgaatcccccatcatcagagtcggcacgcctgccgcgaactcaacattttcaatcccgcggccaacttcggcaatcgcttcactgagactcttaccattttcctgcgtgacaatacgtcccaactcttcttgatgctccaccagcagttgttgatatttgaaaagaatcttggcacgtttaggaatcgacacccgtttccacgtttcaaacgctgctttggccgctgcaactgcatctgccacatcctcgctagtcgaatgcggcacccgtgccaaaacctcacccgtcggcggattataaacatcttcaaaagtatcggtcttagcatcaacccattgaccattaataaaattctcaggtcttaactgcttgttgcgttgcatgaaaacaacccctttgtatagtgagcgtgagccagcgcgcttagaaatccgagtgtaagtgggcctcaaacggtgatgggcggccctttggccattgcggctgaggtccttacacgcagacttctgcgctggcgaacgcgttatgagcgggaaccgggtgcggttagaaaccggagtgtaagtggcctcagacatgatgaccgccctttggtcattgcgtccaaagtcctcacgctggctccatcacccgtttacacacgctcctgtccaattcaagaatggtatgaagcgcttacattttcaaataaattgacttaggaaacttaattcttattaatcttgctcttttcagggaacttatcgtcaaacttgttgtccaattcgatttcctccaatgttctgcctgctgtttccggtgcaaacttccaagcaaaaatcagtgaaataatattggctccgacaaatacaaggaacgtgttcgacatgcctatacttgccaacataactgggaagaaatatccaacaaagaaattaccgatctatcagatgattcgggtgacatttgacaccaaaaatgagttctatgcttatatctcgacaggagtcatcatgatgatccgaccagaccgattggctccttcatgttcttaggcccaaccggcgtcgggaaaaccgaattagctaaagcgttggcagaagcgatgtttggttccgaggacgccatgattcgggttgatatgtccgagtatatggagaaattcagtacgagccggttaatcggtgcagcaccagggtatgtcggttatgacgaaggcggtcagttgacggaaaaggttcgcaacaagccatattcggtcgttttactcgatgaagttgaaaaggcgcatcctgatgtcttcaacattttgttacaagtcttggatgatggctatttaaccgatgctaagggtcggcgggtcgattttcggaataccattttgattatgaccagcaatatcggagcaactgccattcgcgatgataagacagttggatttggtgcaaaagatccaaccgctgacttcaatgccatgaagagtcggatgttggctgaactgaaaaagagtttccgcccagaattccttaatcgaattgatgaaactgttgtcttccatagcttgaacaaggctgagttgcatgagatcgtcaagattatgaccaaaaccgtgcttagtcgtatcaaagatcaaggaattgacgttaaaattacgccagccgggattgatgcgattgccgcggctgggtttgatcctgaatatggtgcgcgtccgatccgccgtgccttgcaaacggatgttgaagaccaactcagtgagctattgctggcgggtcaggctaaaaccggtgacttgattcaaatcggcgctaaaaaaggcaagctgacgtttacagtcaaggaaaacaaaggtaagcataaagaaaacggcgcttctaaagaacctgtcaaggcatgatcaatagcagccccaaatatgtcaggttccactaataacgcttaaaaagatcggtcttagaggtgaagcattatctctgggaccgatttattttgcaaaaacagtcagtgatggcgggatacgatttttgatgctatctggtattgcattactttgaaaagcaggtgcttgacattgttactccgcacgcgtattattaaatcaatcgcatttcggtttggacaggctgtcaggac

SEQ ID NO: 406 - DNA, 2587 bp, Lactobacillus rhamnosus
cggcgccaaaatcgatcgggtttttgaaaccctagaacatcccaaaactaaaaaaagtccgcaattaattgtcgcccgacacgagcaaaatgcagcctttatggcagccggtattggccgtttgactggtaagcccggcgttgtcttgacgacttcaggacctggcgcttcgaacctggcaaccggccttgttacggctactgctgaaggcgatccagttttggcattgtccggacaggttaagcgagcagatttgttacgtagctcccatcaaagtatgcggaatgcggatctttttgcgccgatcacaaaatatgcggctgaagttcaggatccggacaacgttagtgaaattattgccaacgcttatcaggcggcagaatcaggcaagcagggcgcaagttttgtgtcgattccccaagatgtgaccgattcaccggtcaattccgaaccgatcaaaccgttagtggcaccaaagttgggaccagcaagccctagcgacatgacttacttggcacgtgcgattaaggaagcctcattgccagtgttactgttgggtatgcgtgcatcgtccagcgatgtgactgctgaaattcgcgagttgttgtcggtcaccgagttaccggttgtcgaaacattccagggtgccggcattatttcgcatcgccaaatcgataatttctttggccgggtcggtttgttccgtaatcagccgggtgatatgttgttgcaacatagcgatcttgcggggtattcgggctttgcacctgaaccgaaaatgcatgcgtcaactgcgctaaatcacttaaaggaaccaccgcagctagctgcagagcaatcaagcgtagtaacaatgaccaggccgccgtttttaacaataacgtctgtgcctgcatttgttcacgagccagaatcgaaaatcgctccggtgccaggttgtgcagagtcaggtgcaaaagtagccgctgattcgtgttcgctaatggcaattgccgcaagattccggccagcgtctgcacatccccgtggcgaacggctactaaataacggtgcaaaaacggtcgcttattatcggactgtggctgggtaaaggtatcccaatccaagttcaaccgatccagcaacaggaaaaatcgatcggcagctaactgagacgttccattttcaaattttgacagactcgataccgataaaatatcgcccgcagcctcttttagcgtaagtttgcgttctttgcgcatcaacttaaactgtttgccaattgtcaacttgaacgcacctcctcttcaagaaaccgctgccaacttttggtcaacaattgcgcgaaaaaaggagaatctaataacgccaatgtcgccaacaacttttcgatctcggctttggctgcccgatgctgacctcgatgatacatcagcagttgatgctggtaacgcagcatcaaccgcgaataaagatcgtccggcggtattgccaagttcatcgcaatatgccatagacgggtcgcatccgcaaactcacggcgatgaatcaacaaggcaatgctatttgtcaaaatagcccacaaatactgatcccgcaccggatgacttttagtatcaggcaagtccagaaccattccggtcaccaaattaaccaactgctcactgtcataaagcatcaaggtagccgcaaaaagatccagttcatacaagccccaatgccgaatccgttttagatacttgatcacatcatgcttcatcttcatagtggtctgaaagctcggatcggaaaattcattatgggctaaaatattaatctgattcaggcgataaaagacaaatcccgtttgccgccaaagctggtactgcttctgcgccaacgcctgcaacgccgacttacctgctaccgttgcccgttccacttcttgaaaaaagttctcctgattgagcgcccgatacccttgctgaatcgaggccacgtcttggtcaaatcgagtcaacagtttcaaaaccacagcggcactaagctgtgtctcgccgcgttcaaaccgtgacaaagtagcggccgttgtgatcccagccgctatttcttctaatgaatcattttcctcgagacgcaaagtacgtaaataggccccgattttgatagcttcctccgtcatcagcacccgacccttttatgagaactttattaaacaaatttaacacgttttgccattttttaaaatatctttttgcttgtatcttcctgatgatatgttttaatcaagtatgacaccgtttacatcaataaaacgaaggagaatagccatgagagaatcgcaaacctggatttcttttttaagcaccagaaaccccgccctcaagatgcgttcctttgggatactgtttcataaagacttgtctattagccggcccgtatagcgcttttatgagcttgttcatcaccggggaaatattatggactttttccgcaattatctttatgcgcatcgtggtcttttgtgctaatatagctgcagctatctcctatgcaaagaaaggaaccttggtaagcctttttaagttcaaaagaggtggctcggacaagcttttgcttcaacgttggg

SEQ ID NO: 407 - DNA, 2665 bp, Lactobacillus rhamnosus
agaaaaaagtttggatccatttggtgtgtactttaattcgaagtcgagtatcccgcagtgttggcaaaccgcgatgttctttgcccagattaaacccgcccaaatatgccaaatgcccatcaatcacaatcagtttgcgatgattgcgaaagttgatgcgcggattccaccgtccgagtttggtcgccacaaatcgctccacctgaccaccggctgctgtcaagcctttccaaaagctaatcggtaaaccgtgcgaaccaaacgtatcgtataaaacgcgcacggtgatccctgcttgcgccttttcaatcagtaaatcacgcaattgccggcccactgcatcaggctgaatcgtataggcttcaatatgaatatgttcggtagccaagccaatatcttcaaacaactgtttaaaaaaggcttcccgcaaagaaagcacctgaacttcattgtgagttgtgaccaacgcatcgtccgcccgcaataacgtccgcaccagctccgaaaccccaccgctacctggcgtcccaatcaacggctgccctgccgcaagcgcttcttgttgctgaaccaccaaatcattaatacccagtagccgttgcgtcattaaatcctgcatgcgatccgcccgcagtttacgcccaaagacaaaataaattaagaaaccaacaaacggcagcagcaacagcacaagcagccacgcccatacagcagaaatatcacgatgggaccgaaacaccgtcacaatcgcaataaatgcattaatgatataaagaccgccaacaatcagcccaagccacataaatttcgcctccctaaccagacaatgtcacacctcagccattcgtccagtctctacatgcgattatcatactctactttacagataatcagggggaaaagtccagtgagcgcgagccagcccggttagaaacctgaacataagcggccttgggcgtgatggccgggttttggccattgcgcccaaggcccttatgtgcaggtttctgggctggcgaacgcgttatgggcgtaaaagcggactagtggcctcaggcgtgatgaccgggctttggtcattgcgcctgaggtccgtacacgcagacttctgcgccggtgagcgcgttatgggcataaaccggaacataagcggccttgggcgtgatgactgggttttggccattgcacccaaggtccttatgtgcaggtttctgggctggcgaacgcgttatgggcgtaaaacagaacataagtggcctcaggcgtgatgaccgggctttggtcattgcgcctgaggtccttacacacagacttttgcgccggtgagcgcgttatgggcataaaccggaacataagtggccttgggcgtgatggccgggttttggccattgcgcccaaggtccttatgtgcaggtttctgggctggcgaacgcgttatgggcgtaaaacaaaacataagtggcctcaggcgtgatggccacactttggtcattgcgcccaaggtcttgatgtgcaggtccctgcgccggtgaacgcgttaagggaggcgtgttgagcaaccaacaaaaaagccggaatcaaagttttcatgcagttacctgtcacaatagacagtatccacacaaccacaatgattccagcctcaacataaaattgccacgatgtctaaactctgaccccttatcagcgctaacatacaactcattgttcgaccttgccaaaccatttcttctgcagtttagcaatcgttccgtctgccttcaacgccttcaatcccgcgttaattttctctcgtaaaacatgatcggacttgcgcataccaaccgcgaactcttctggcgggaatgagtcgccgataatgtgataacttgcaggatccggcttgtgggcaatgtagtaacgtgcgtaaacctcatccattaaaatgccttgaattcgcccagcatccaagtcaataaatgcatcattgaaggtatcgtagaggatcggggttttgttggcgatcatattttttaacaatttgggttgggcatctaaatcaaacgccccgcttgatccggtttgcacgcccaaggttttccccttcatatccttcaacgtgttaatctgacttttggttttggtaaccagaatttgatggttaatcagataatcattcgaaaaagcaacctttgctttccgctccggggtcacggaatagccattccaaattaaatcaatggtctgattttttaattcggtttccttcatcgaccagtcgatggtctggaaatccgctttaatgccataccgtttgaaaaccgctttggctaaatcaatgtcatagccggccaactgcccatttttttgacgaaaacccatgggaacaaaggtatcatctaacccaatcacaacttttttggtccgttcaatgcgcggccaggagttgtcgacggtttcgcgcgcgcatccactgattacgataccggccatggtcaaaaacgccatgacggccattatcattcgccgtttcattgaccatcaccgcctttgccaacgtgataagtcgtgtctgcaacactttgggcaaagtccatgtcatgggtcacaaccacctgagtcatacctgatactttaaattggttgaccattgcggcaacattatcgcgcaacatcggatccagcg

SEQ ID NO: 408 - DNA, 2634 bp, Lactobacillus rhamnosus
cgctctagaatcgatttaattcatttagggaaacgaatgatatgagtgagtagatttgatgagactgtacagaaaacctggttggctgagagcagggtagttgattgaattgaagatggctcattgatcggcatcgctgagcattggttaagcgatgatggctggcggtcattattccgcacacaggttattgcctgttactgagggcgctttggcgtcgaattagaatggtaccgcgagttaactcgcttctaaaacattgttttggaagcgggttttttttaattttcggcaaattgctgacacatattgtttgtgacccgaacgaggaggaaaaagtttatgaagttttggaaaagagccattataacccttgcattggttttacctgtcttcgtcttggcggcgtgccggtaagtcgtcatcgagttccagtaagaatgagacggttaaagtcggcattatgagtactgacaaagaaatctggaccgatattcagtcccgcttgaagaagcaaggcgtcaccattaagttggtgcagtttactgattataaccagccgaaccaaacactttgaagatggcgatattcaactgaacgcttttcagcatcataatttcctgaataactggaataagaagcacaataccaagattgccgatattggcgatacttatatcggcccaatgcgtgcgtattccaataaaatcaagtcacttaaagaggttaagcaaggcgatcagatttccttgccaaacgatccatccaacgaaggccgcgcattacaacttttggcacaaaataagttaatcactttgaagaaaggcgttgcttcaccaacgatccgcgatattacttcaaacaagattaacttgaaattcacggaactggatgccgcccaaacagcacgctcattgaacgatgtggccgttgcggttgtcaacaatgatattgccgcagcagctaatctgaaaccgtccaacgcgattgccgttgaaaagattacgagccaatccaagccgtgggtcaactttatcgctgctaagtcttctaaggataagaacaatgcaacctataagaagattgttaaggcctatcagacaaagcggacagctaattgttgaagaaggtttataaagggtcaacattaccggcttggaactataagtttaattagaaacggggacaatttatgtcaagatcaagcagttgtgactttaaaagatgtggacgtcgaattccacggtaaaaaccgttcagtccatgccgttgaccatgtaaacctaaccgtcaaccgcggcgacatttatggcattgtcggctattcaggcgccggtaagtccacacttgttcggacaatcaatttactgcaacggccaactggcggcagcattcatgtattaggacaggatatgcttgctttatcaccggcagaattacgtaaagaacgtaaacggatcgggatgattttccagcattttaatttgatgaatagccgcaccattgccgataatgttgcgtttccgctaaaaggtatcaagtccaagcaggagattcaaaagaaggttgctgagctgttagacctcgttgggttgacagatcgcgccaatgcttatccggcccaattatccggtggccaaaagcagcgcgtcggtattgcgcgggcgcttgcctctgatcctgagattttgatttcagatgaagcgacgagtgcgttggatcctaaaacgaccagttcgattctggaattactgcagtcgctgaacaaacggctgggactgaccattgttctcattacccaccaaatggaagcggtgaagcagatttgtaatcgggtcgccgtgatggatgccggcgcgatcattgagcgtggtgacttattgcaagtcttttctgatcctaagcaacagttgactaaagatttcattgatacaactttgcaactggatcaggcaattgaagccgtgatgcagcagccggcagttaagaatctgggtgctaatgaccggctattgcgcttaacgtatgtaggagattctgcggataagccgctggttgccaagttgtttgaaagctatcatgtgaccgccaatatcttgtttggtgatattcaaatcctgcaggacacgccttttggcaatctgattgtggtgttatcaggtgctcaagcggatgttaatgccgggattcattatctggaacaacaggatgtcaagattgaagacattcttaagaaggaggcctaagcagatggcacaattttttacaaaatattttcctaacgttgttcccatctggtccggtgatggcggcgtaactcaagccattaacgaaacgctgtatatgactgctttaaccgcaatcgtggctggtatcttgggaattatcatcggcatcttgctagttttgactgatgaaggtgggttgcttgccaatcatccgttttactttattttggataaattggttaatattttccgagcggtccctttcatcattttgctggcgattatgacgcccgtgacccgagcaattgttggtacggggattgggccgactgcggcattggtacctttaatcgccggcacgaccccgttttacgcgcggcaggtacaaaacgcgttgttaacggtt

SEQ ID NO: 409 - DNA, 3269 bp, Lactobacillus rhamnosus
actgtccaaggcggcggttccggtgccggcttaagccaagtggcagccggatcggtcacgatcggtaactcggatattttcgctcaagaaaagaaagacttgaaggccgatgatctggtggatcaccaggtagcggtcgttgccattgcgccggtggtcaacaaagatgccggggttaagaacatctcaacccagcaattgatcgatatcttccaaggcaagattacgaactggaaagacgtcggcggcaaagatcagcaaattgttctgatcaatcgtgcgcaaggttcaggtacccgggcaaccttcgaacagttcgggatcaagaccgataaagtcaagaccagtcaggaacaggattctagcggtaccgtttatcagatggtctcctcaactcccggtgctattagctatctagccttctcggcaattaaagatggcgtccaaaagctggcactggataaggtacaaccaactgataagaacgttacaacgaacacctggaagatttgggcttacgaacacatgtacaccaaaggcaaaccgaacgcatcgactgccgcatttatcaactatatccagtccaagaacgttcaaaagactctggttccaaagttaggctatattccaatcaccaagatgaccgttgctcggacttatgacggtaagattgaagaagttaacaagtaacctacccagcatcactaaataaaaagcagcatgtatacaaaaaccgcgatcaacgcaatgatcgccggttttcttattgtcctataaacttgagtcgtcaacattaaaaagcaatcctgacagccacagacatatttgggaggaagcatcactagcttgttacccaaagacagactgttcggattgcttttaatgaatcacgtcacacgattgaacgagaatttatgcatgatcctcaatggcgggttcgtgatggaatcgtgacatttgctgcttgcggaccccgcggaccttcgacaatgacaaaatcgacctgttcaccgggcgtcagacttttaaatccagactcattaatcgccgaaaagtggacaaaaatgtcaggctgcccttcagcttcaataaacccatagcctttatcgacgttgaaatttttgacccgtccttgcatcatagcctccgcttacttatcaaatccgtttgctgccgcttcaggataattggcttcaacaatcgcggcacaccgactgcataattccggcaatttgggatctgtgccgatatcggttcgtaccatccggcaacgtgggcaaaccgttcctttggcatgttcaaccacaacagccatatcctcaaattgttcggcattttccggtgccttcgcctcaagtggcgctacttcaaagtgactggtaatcagcaattgcatcacattggcttcaacatcatcgagcatgtcgcgcaccggctccgttgggtaaactgttaccgctgcctccatggacttaccaattaccttgttgtcacgggcaacttccaaggctttttgaacttcggaacgaaaatccataaacgctgcccagatatctaggagctgatcctcatcagcaaagtgggtcacatctggcatgtcggataacgctgcgtatgcttgtttctgcttaagatacggccaaacttcttcggcagtatgcggcaggatcggcgtcaacaacttggtcaaatccagcaatgcggtgtacataaccgtttgcatgctgcgacgtttaggatcgtttgcggcttcaatgtataccacatccttggcaacatcgagataaaaggcacttaaatcgttgaccaggaaactgctgatggttttctctaccgtagcaaagtcgtaggcatcatacgcttctttgactttggcgatgatctgattaaccgaaccaacaaataacgatccactgaacctagctgatcataggcaaccgcgtctttttccggatcgaaatcgccggtattggcaaccatgaaccggagcgtgttgcggattttacgataggcttctgacgtctgagcgaaattatcgactgagacccgaacatcagatgatgaatcaacagttgcaacccagagccgaatgatctcagcgccaaactgcttttcaatggttgacggcacaatcgtattacccaagctcttgctcatcttccggcctttgccatcaagcgtgaagccttgtgacaaaatcccgcgatacggcgcgattccggttgcagcaacactggtaatcaagctggagttaaaccagccgcggtattgatcggaaccttccagatataagtcagccgggaagctcagttcaggacgttgcgccaaaacagcttggtgtgatgaacctgagtcaaaccaaacatccataatatctttttctttagtgaacttaccatttgggctgtgcggattggtgtacccatcaggtaaaagatccttggcctcgcgctcaaaccagacgttggaaccatatttaccaaacaaatccgctacatgattgatcgttgcttcttcaataatcggctcaccgtcttctgcatagaaaatcggtaatgggacgccccatgcacgctggcgggagatgacccaatcgccgcgatcacgaatcatattgtacagccgcgttttgccccaacttggtttaaagtcaacggtatcaatggccttcaaaatctgatcacgaaaggcctcaattgacgcaaaccattgagtggtggcgcggaaaataaccggcttcttggtgcgccaatcatgcggataactatgggtgaagaagtccaacttcagcaaggcgcctttttcgtccaaagctttcgtgacgagtttgttggcatcatcataaaagacgccttcaaaaccaggggcattttcattcaggtaccctttggcatcaaccactgaaataaccggcaagccatatttcattccgaccttgtagtcgtcttccccatgaccaggggcggtatgaaccaagccagtcccggcatcaagcgtaacatgatccgcattcatcactagacttgtccgatcatacaacggatgcttggctgtcattttatccatttcagtgcctttaaaagtctttaagatcttagggtgttcccagccgacttcttcagctacccgatcaagcaactcggcagcaacgacatacttatgctcgccaacttgcacctggacgtattcgaagcgcggattgactgcaatgccgtagttggcaggaatggtccaaggcgttgttgtccaaataacaagtgacgtatctt

SEQ ID NO: 410 - DNA, 10303 bp, Lactobacillus rhamnosus
gaagcggccatactcgccaataaagtcagatattagcagcccgagtataacgtcttgtgcatcgtctaaaagcacgataggcacccaccataccggtgtaaagatattaacggcatgaggcgtacgcctactctgccaacgcaggtcagtttccggacagaatccagaaaccccgcagaaccggtggtataacctgctgcggccgctgaaccaaaaccagtgcaccttccctttcgtcgagtgataaaccgtaaacatgtctgtagaagatactcacccgcttatcacgcatctgattgagccgcgtgagcgtctgctgaactgccattatcgcggtgatcgtgatattcctgtgtctggtctatttcgccaatgacatctatcacctggtatccgcgccattgatcaagcagttgccgcaaggttcaccgatgatcgcctccgacgtggcctgccgttctttacgccgatcaagctgacctttatggtgtcgctgattctgtcagcgccggtgattctctatcaggtgtgggcatttatcgccccagcgctgtataagcatgaacgtcgcctggtggtgccgctgctggtttccagctctctgctgttttatatcggcatggcattcgcctactttgtggtctttccgctggcatttggcttccttgccaataccgcgccggaaggggtgcaggtatccaccgacatcgccagctatttaagcttgaagatggctgaccacccgatatttaaggaaccatgatggataacttccggtgcaagctttttgaccaaagaaaaaacaccgccaatgaaatggacggtgtgttgccgctttcattaaaaatttcggaagcgggcttgacgctgggtaaccagtgtctgcggatccaatgccataagggtcgccaactttggcttaacctcggctttgagtgcgctggggaagtcggtaccggtatccgtaattatccgatcacagacttttttagccaacaaatcccgcggggtcagttgcatgacttcagctgcttctttggcacggctggaatctttccacaaaatcgctgcaaagccttctggtgacaagatgctgtacatgcttttatctgtcatccagacttcatcaccaaacgccagcgccagtgccccgcctgatccgccttcaccaaccaatactgccagaatcggtgtcggtaaatcggcgcacgtgacgagcaagtctgcaatcgctgccccttgcccatttgcctctgcttctttacctggataggcaccgggtgtattaatcagcgtgacaatcggacgatgaaacttcgccgcctgtttcataagccgcaacgccttgcgataaccccaaggctccggactgccaaaatgggtctgcaaccgttctgtcaagtcattgcctttatcggtcgcaatcacagttgccgcttggtcatccaaccaaccgatgccgccaatgacagctggatcatcatgactggaccggtcgccatgtaactcatgaaaattggtgactaagccattgatgagttcgcgggtggtatagggacggggtgcgcgcgccgcttgaacggtggcgtaggcggatgtttcttttttgggcatgccagggtacctccttgcttcgtgttggtgctggtggggatgttttccgatgctgaaatgcgttcacagttacagaaatctgcgtgtatgggcctctagcctatatggccaaagaccggctggctcgggaaatcacttttgtttcggttggggacattctccgatgctgaaacgcgttcacaggcccagaaacctgcacgtaaggaccctgagcctaaatggccaaagaccggccatttaggctcagggccacttacgctccggtttctaagcgggcctgttcacgctctgtgcatttgtaacagttccccgatataatccgcttgttcgcttctcttcacgatggcgtcgatgaagccgctttggaggacggtttcggcgcgttggaagttttgcgggagtttttggttgatggtttgttcgatgacgcggcggccggcgaatccgatgaggctgtggggttctgccagtgtgatatcgccttgcatggcaaagctggctgtgacgccgcccatggttggatcggtgagcacgctgatgaacaataagccggcattgctgtgattcttgactgctgcactgaccttggccatttgcatcagtgaatgaatgccttcttgcatccgtgcaccgccacttgcgcagtataaaacgactggcagatttgcttcggttgctttttcaaacaaacgcgtggtccgttcgccagtcacggttccgagtgaccccatcataaacttaggatccataatgccaagaccgcatacctgtccgccgattttcgcctgaccggtccaaacgctgtcttttaaaccagacgcctgacgtcccgcggctagtttcttctcgtaacccggaaaatccagcgggtcggtcgtggttaaatccgcatcccattccgttgcatctgtcgctaccagggctaaccgttttttggccgtgatgcgaaatccataatggcaatgcgggcaaacttgggcatcgccgagactttcacgataactgccttgcttgcagtatggacattgaatccataggttttcaggcaaagccgcctcacgagcaagtgcttcttgggttagttgtggttggaacatgcagcatccttcctttcatcctgccattgtgggcaaaaagtcacggttgagataagccgtatcagcttctccagccaataccttgggtgcctggaaaagtgccagtgcaaagtcgcggttggttttgacaccttgaacgtctaactctgtcagggctcggtgcattttagccaaggccgactgacgcgtttggccatgaacgataatcttggcaatcatcgcatcatagtacgggctgattttatcgcctggcgccacgccggtatcgacgcgcaaacccagtccgccagtcggaaaacgtaattgttccagcgtcccgacatcgggcataaactgatgatccggatcttcggcattgagtcggcattcaattgcaacgcctgaaggttccggcgtggtcaactccacgtcttcgcctgccgcaatgcgcaattgtgcctgaaccaaatccacgccggtcaccatttccgtgatcggatgttcaacctgaatccgcgtattcatctccatgaaataaaaatgatgctgctgatccattaagaattcaatcgttccggcattgaggtaatcaacgccgtcagcaatcgtttcggctaaatgcaacagcttagcccgttccggtgacgttaacaccgggcagggactttcttcgatcattttctgactgtgacgttgcaggctgcaatcacgctcgggaaaaacgctcacgtgcccttgctgatcgcgcaatacttgaacctcaacgtgtttagccgggacaatcaccttttccaggtacatggtgggatcaccgaatgcagcttgggcttctgcctgcgcaccggcaaattcggctgtcaggtcatcggcactcgccaatttacgaatacctttaccgccaccgccagcactggctttaagcatcagcggatagccaatcgcctgtgcagccgccaatgctgtatcgacatcctgaagcggccggctgccagggatcaccggcacaccaatatcaatcatcgtttgacgggcaacggctttatcacccatttgctcaatggcagtcggcttgggcccgatgaaggctaacccggcatcagtcaccaacttggcaaattcggcattttcggataagaaaccaaaacccgggtgcaccgcctccgcaccgcttaaaatggcggcactcacgacattgcgcatattcagataagaatcagttgcccgcggaccaccgatacaaatcgcttcatccgccagcaagacatgtaggctgtggcgatcggcgttcgaaaacaccgccaccgaggtgatgcccatttcccgcaacgtttgaatgatacggaccgcaatctcgccacggttggcaacgagtacttttttgaacacagttccacttccttacacgagtctgaatcgggtcgatttaaccaattgcaaagacaagttcggcactgcaagccatatcttcgccgacgtaaaccttgccttttcctaagccggcattgtcgatcaatttctctaaagtgacctcgatgcgcaaaacatcgccggggcgtaccatgtgacggaacttggctttcttaatgccgccgagataagctgttttacctttaaagtctggcatcgaaagcaaagcaattgcccctgcttgcgccatcgcttcgatctgcaaaacgcccgggaaaatcgggttaccgggaaaatgcccttgaaaaatctgttcattgatagaaacgttcttttgtgcaaccacagattcgccgggtttgagatccagtacccggtcaatcatcaacatgggataacgatgtggcaaaatcgcctgaatttcttgtgcttcaagtgtctttttggtttcgagcatgaatgctatcctcctaaaacgtgtttatggagccggaatgcgactcggtttacgctttgtcttcttgtacgatgagcaacggctggtcgtattcaactaagctttcgttatcgactttaaccgccttaaccgtgccgctaacagtacttttaatctcattcatcattttcatggattcgatgatgcaaacaacgtcacctttttttacgtgatcgccgacttgaaagtacggatcagcgcctggtttaggagccaaataaacgattccgaccagtggcgctttgaccgctgtgccttcatccgcttgcggcttgtccggtaccggcgtgacaggtgtcgctgccgtattttccggagccggggtcacaggtgcaggcgcggcagcagggcttgctttgaccaaatgtagcgagtcgttaccaagtgtcagttccagctcgtgcagcgaactttgctccaactgtttgatcaaaacttcgatcattttggtgtccatgacactcaccaccttttgaaggccaaaacggcattatgaccgccaaagccaaaggagttactcaatgcataatcgactgatgtatcacgattgtcgcgattaaccagcgtgaccgggcaatcctcgtcttgagccgcatccaccacattcattggcaaccggccgctttgtaaggcacttagcgtcatgatcgcttcgatggccccagcagcacctagcagatgtcctgtcaatgccttggttgagctaaccaacacatcgtcgccgaaaagatcatggatggctttactttccatcgcgtcattggctttggttgctgtcccatgggcattaatgtagccgacttcacttggcttaatgccggcttcttcaacggccaattgcatcgcacgtgccgcctgagagccacttggatcgggcgccgtcatatgataggcatcactggtggcaccatagccaaccacttcacctaaaatcttagcgccgcgtttttgtgcatgctctaggctttcgagaatcaatgcaccgccaccttcgcccaaaacgaaaccattccggtcagccgcaaatggcaggctggccttggttggatcggtatttttggacaatgcggaaagcgcagcaaaaccggcgattccgatctcgttaactgaagcttcggcgccgcctgtaatcacaacatcggctttaccggtttgaatccgcatcgctgcttcgccaatcgcattcgtagctgaagcacatgccgttacgacaacatagctggggccatgcgtaccaaagtaatgggaaattgccctgcgaccatgttactgatggcttccggcacgaacagcggactcacgcgatccgggccttttacatacatcttcgtcacttgttcctgaatggttgtcaaaccaccaatcccggaaccgaaaataacgcccactcgatctgaatcgaccgcatcttcagttagaccggattgttcatatgcttcaatggcactatagagaccatattgggtaaacagatccatccgtttacttaggcgtttgctcatccgttcttcgggtttgaaatctttgacttcaccagcgactgtgattccggttttttcagcatcaaacttggtgattggctggatgccgaccttgccagcgtccatcgtcgccacagtttcggcgactgaatggcccagcggattcacagtacccattccggttacgactactcgttgcaatgtcattcctccgttcatgtacttaacctaatccgccggcgacagtcactgtctgaccggttatgtaggcattttcgaccagaaaacgggccgtgtgggcaatttcttcaggttgaccgaaccgcttcaacggaatttccgccagaatctggtcctgactggattggctcaaggcagcggtcatatcggtggcgatcatccctggggcaatggcattaacgcgcacgccacgcatagccccttcacgagctagcgtcttagtcagcccgatgatgcctgctttacttgccgcataattggcttggccgatattaccggtcaaaccgaccacactggccagattgatgatgacgccagcgcgggcctttagcattttcttgaaggccggttgggtaacataaaaggtgccatccaagttaacctgaacgaccttggcaaaagaagcgggtttcatgcgcatcgccaacatatcgtcggtaatgccggcattattgaccaacacatccacactgccaaactggtccaaggcagcggcaaccaattgatcaccggttgtgggatcatccacaactgcccagcacggtcacaacaccgtggccatagtcttctaattctttgatcaaagtttccggaaattcatgccgtgcattcaagaccaagttggcccctgcttgagcaaaatttctggcaatcgcttcaccgatacctcgtgaggcaccggtgatgatcgcggttttatcagttagtttcaatctgccttcactccgttattcaaatcggctacctcattgagacttgctgcatcacgaatcaggtaggttgtcatcttgcggtcaatgcgtttaatcattttactaagcaccggtttcgggcctaattcaacaatcgtatcaacgccttgtgctttcagttgtgcgatcacggcagcaaacttcgtcggttcggctacttgcgccgccaataccggtcggatgttgctagccgaaaatggcttaagtgccgtcgtactaatgaccggaatcactggttcaaagacatgagccgctgccagtgccgcttgtaatggtggttgtgcacttgccattaacggactatgaaagcccccggcaacttgcaaaggaatggcgcggacaccttggtctgtcagccacttttcaaccgttgccaagtcatcatgtgtccctgccaaaaccgtttgcttcggaccattgtaattagctggccaaacatgttctgcctgctgacaagctgttttgatgatggtctcatcgccgctcatcaccgccagcatgccgcctggttgttcttgacacgcggcggccatcgctttaccacgggctgcaacgagctcaagtcctgattctaagctcaacccgccacctgcgattaatgcgctatattcgcccagactcaagccggctaaagcagcttccggcggcaactctgctgaggcaacctcatgcatggccacactataagcaactaaggccggctgtaggtaatccggatgggccgcaaaatcaccattagccaaaaactctggcaagtcaaagtccaaaacggcatcggcacgatcaataatctctttgaatatcaaagtattctggtaaaaatcaatccccattccggggacctcggcaccttggccgttaaacacataagcaaattgcaaaaagtggtacctccttgcctgcgtttgggttacgcttgcacgtcaacctgactagtgagcaaagccgccattttcgagccggcgacaatttcttttgcctgctgcatgacttcttcaacaatgtccttgctgctttcttcgcgtttcactaatccggcaatttcgcctgccataaaggatccatggtcgcgatcgccttctaaaacggctttacgcaaactgccattacctaattcttccactgctgtaaaatcagtggtgccagaaagcgcaatttctttttccagtttgagataattgcgactcatcgggttcttcaagacgcgggctgcatgaccgacatacataccggtaacaagggtatcaacgtcttttgctttaatcacagcgtctttgtagttttgatgaatgcggcttgatgttgaggttaaaaagcgggtccccatttggacaccaactgcacctaaactcagcgcagccgcaacaccgcgaccatcgccaataccgccagctgcaacgaccggaatatcaacggcatctaccacttgcggcactagggccatcgtggtgatactgccgatatgaccaccggattccatgccttcagcgatcacaccatcaacgccgtcacgagccatgcgcttagccatcgcaaccgacggcacaaccggcatgaccacagtgccgttttgctggagccgttccagatagcggctaggatcgccggcgccggttgttaccaaggcaactttggcatcgacaatcacatcaatcacctgttcgacaaacggtgacagtaacatcacgttgacaccgaatgccttgtcggtcattgattttgcaacttcgatctgttccttaacccatgaagcaggtgcatgaccggagccaatgataccaagaccgccagcttcagaaaccgacgcagctaatttgccgtcagcgacccacgccatgccgccttgaaaaagcggatatttaacgcctaaacgttccattaatggactcattggcccactcctctccagtgtcttaagcttcagccttttcagtgatgaacgtaaccaaatctgaaaccgtttcgatgctttcgtcagtatcgatcttaacgtcgaattcgtcttcgatttcattgatgatttcgaaaatgtccaagctatctgcatccagatcgttcttgaagttcgtggtcaaggttacttcttcaggcttcttgtccaattggtcagcaataatactttgtaccttaggcaatacttcttcgttagtcatgtttatatgttctcctttgagtgttaagttttgaccgtttcattggtctgtcaattgtaaccgttagttagtaagtcatgataagtgagccaacagacaagccgccgccaaaaccgctaagcactattttctggccgcgttttaactgaccgctttctgccaactgtgccaacagaatcgggacgctggctgcgctggtgttaccatactcatcaatattgatcggaaattttgcttccgcgactttcaactttttattcactgattgaacaatgcgcgcattcgcttgatgaagcaaaaaccagtcaatgtcatctgttgtcagattagcttgttccaaagcccgattgatcgagcgaggtacttcgctaatggcaaactggtaaaccgcgcgcccattcattttgaaatatggcgacgcttgcgcttgtgcatcggcaagggggctttgatttgcttgctccccagccaacaacaccatctcggtatcaccgaaactctttaaatcaactgcttgaaccggggcgccttgatcactaaccaaaacgccgccagctccatcagcgaacaaaactgctgtgcgccgatcatgccaatcaactaaccgggaaaggacttcactcccgatcaccagtccttgatgaacggtggggctggtcatcagccgatcagcgacatgcaacgcatattcaaaaccggcgcaagcaacattgagattaaacgcaaatgcgtgattcgcatttaaagctgcttgcaggcgattagcctcggccggggtggcgtagtccgggctcatggtcgccacgatgatgaaatcgagctgatcggcggtgaccgtcgatttttctaacaattgttgggcgacatcataggctaaatcaaagttacgctggtcagtgaccacatgccgggttttaatccccgtgcgttctctgatccaaccgaaattaatgatgtgccgctgccaaacggtaagattaagagtctgcgcgcctcctattattttatgggcgcgttattagggcgctttggcaaagcaattgttgggctgcctggtggcgatgatatcggtccgcggcctatt

SEQ ID NO: 411 - protein, 465 aa, Lactobacillus rhamnosus
MTINWQQEVEKLEPQLLSDLTTLLKINSERDTDHQTDEYPLGPGPAKALEAFLAIAQRDGFKTLNVDHVAGRIELGDGDEIFGLFGHVDVVPAGPGWQTDPFDPVIRDGKIYGRGTSDDKGPSIAAYYALKLIRDLKLPINKKIHFILGTDEESDWVGIHRYLETEPAPDFGFSPDAEFPIINGEKGIASFEIVQKPIAAATADLTLNHFSAGIRPNMVPQEAKAVLSGPLPEAFVTQAEKWAAEQEVTLTLTLGNPTTIELIGKGAHAQEPKDGKNAATYLATLLADLPFDPAGKAYLTMIANHLHLDSRGHHLGINYTDKLMGDLTASPFTFTQDGPQSVLVNVRYPQGTDAAKIRDQIETALGADQYNVAVSGHAQEPHYVSGDDPLVKTLLQTFSDHTGIPGHEQVIGGGTYGRIIKRGVAFGAQMPGQENVMHQANEYMPIKDIVAAVAIYADAISRLVM

SEQ ID NO: 412 - protein, 439 aa, Lactobacillus rhamnosus
MKNETLAALYEAQRMTFIQALRQIMQIKSVRGSQQADAPFGRGPRAALTAAAELGKAYGFKTGIVNSAMAYIQWGDDDQHYIGIVGHLDVVPAGETDWHFPPYDLSEKAGRLYGRGILDNKGPSIACLFAMKLLKDAGFQPKRTIRLILGSDEESGSADVPLYLAKEAPPEFGFTPDCKFPVVYGERGIVNFNLRTPITDDSLDKVATITGDQASDHVPDHLQATINDKRYTASGIRAPSNAPELGKNAITTLAKELLDEHAIHGQFANYCQWLVQTLANQHHGEGLGMDFADAASGRLIVTPYQLQKIGAVISLRVAVRYPVTYQEHDVTRALTAAVFPRTQITVIRSMPGILHDKNDPRLAALTQAYEQVTGREGQPVTTTGATYARKMPNIVAFGPSFPGQKGIAHKADEWMDEHDLKLNMMIDMNAMIRLGAMDK

SEQ ID NO: 413 - protein, 317 aa, Lactobacillus rhamnosus; identical to SEQ ID NO: 383

SEQ ID NO: 414 - protein, 187 aa, Lactobacillus rhamnosus
MSAVPKRIQKWSWLLAITVLNDYWAKQPVPGAAFPGMGNSKTKATGEMNPTSGATKGNNSKTGTAPTGTKGNPPTGTKGTKGTTGTPPGGNGGGRPGNGQGQGGTPPAGTNGKQPTVKTKSGTSTNNAPANFAEGNFKGGRGTGGGAAGGRGGGAAGGRGGGAFSIGNAGPLRLLQSDLGNRWPWHG

SEQ ID NO: 415 - protein, 175 aa, Lactobacillus rhamnosus
SRIGYKVIKVPAGVTVTKDGDNITVKGPKGELTRHFAPEIELHQEGDEINFTRPDDSYKAIHGTMRANLNNMVVGVTEGYKKEMKLVGVGYRAQKQGEKLVLNVGNSHPVEMPAPKGVTVEVPSTTQIIISGISKQVVGQFAAVVRSVRAPEPYKGKGIRYVDEHVRRKEGKTGK

SEQ ID NO: 416 - protein, 653 aa, Lactobacillus rhamnosus
MSAMELKSQGREAESAAADTVRLTTAQALVRFLNQQYLDVDGEVTPFVEGIFAIFGHGNVLGLGEALQEDPGHLKVYQGHNEQGMASTAIAYSRQLYRHKIFAVTASAGPGSANFVTAAGNAYVNNIPILFLPADTFATRQPDPVLQQIEVDSSATTTTNDALKPVSRYWDRIERPEQLMSALLKAFEVLTNPETAGPVTIALPQDTEGEAYDYPRSFFNKRVHVIKRIQPSAAEVTEAVQLIKASRYPVLIVGGGAKFSEAGSAIEAFSDKLNIPIVETPTGKSTISATFANNMGGTGILGTAAANEVVAKADLIIGAGTRYTDFTTASKTAIHPEKTRVLNINLNRMQSYKFDGFPIVADVRDTLTQLTSELSGYQSDFTNLADLKAAWQQERQRLAHTNYDAPDYTPEVKGQFSAATLAEYAEKLQTHFTQTEAVIAVNDTIAPDSIIVAAAGSLPGDVQRIWDPVVPNTYHMEYGYSMMGYEVPAALGIKLAQPDKESYALVGDGSFIMLHSELVTALQYHKKINILVFDNSGFASINNLQMAQGSNSYRTEFRTADHDILTIDFAKIAEGYGAKTYHVNDRDSLVAALEDAKKQTVSTLIDIKVLPKTMTQGYGQSWWRVGVSEVSDNPNVQKAYQDIQTGIDQAFKY

SEQ ID NO: 417 - protein, 362 aa, Lactobacillus rhamnosus
GAKIDRVFETLEHPKTKKSPQLIVARHEQNAAFMAAGIGRLTGKPGVVLTTSGPGASNLATGLVTATAEGDPVLALSGQVKRADLLRSSHQSMRNADLFAPITKYAAEVQDPDNVSEIIANAYQAAESGKQGASFVSIPQDVTDSPVNSEPIKPLVAPKLGPASPSDMTYLARAIKEASLPVLLLGMRASSSDVTAEIRELLSVTELPVVETFQGAGIISHRQIDNFFGRVGLFRNQPGDMLLQHSDLAGYSGFAPEPKMHASTALNHLKEPPQLAAEQSSVVTMTRPPFLTITSVPAFVHEPESKIAPVPGCAESGAKVAADSCSLMAIAARFRPASAHPRGERLLNNGAKTVAYYRTVAG

SEQ ID NO: 418 - protein, 270 aa, Lactobacillus rhamnosus; identical to SEQ ID NO: 269

SEQ ID NO: 419 - protein, 270 aa, Lactobacillus rhamnosus
MKRRMIMAVMAFLTMAGIVISGCARETVDNSWPRIERTKKVVIGLDDTFVPMGFRQKNGQLAGYDIDLAKAVFKRYGIKADFQTIDWSMKETELKNQTIDLIWNGYSVTPERKAKVAFSNDYLINHQILVTKTKSQINTLKDMKGKTLGVQTGSSGAFDLDAQPKLLKNMIANKTPILYDTFNDAFIDLDAGRIQGILMDEVYARYYIAHKPDPASYHIIGDSFPPEEFAVGMRKSDHVLREKINAGLKALKADGTIAKLQKKWFGKVEQ

SEQ ID NO: 420 - protein, 261 aa, Lactobacillus rhamnosus
  VARIANT (1)...(261): Xaa = Any Amino Acid
MKFWKRAIIXPLHWFYLSSSWRRAGKSSSSSSKNETVKVGIMSTDKEIWTDIQSRLKKQGVTIKLVQFTDYNQPNQTLXEDGDIQLNAFQHHNFLNNWNKKHNTKIADIGDTYIGPMRAYSNKIKSLKEVKQGDQISLPNDPSNEGRALQLLAQNKLITLKKGVASPTIRDITSNKINLKFTELDAAQTARSLNDVAVAVVNNDIAAAANLKPSNAIAVEKITSQSKPWVNFIAAKSSKDKNNATYKKIVKAYQTKRTANC

SEQ ID NO: 421 - protein, 71 aa, Lactobacillus rhamnosus
MMQGRVKNFNVDKGYGFIEAEGQPDIFVHFSAINESGFKSLTPGEQVDFVIVEGPRGPQAANVTIPSRTRH

SEQ ID NO: 422 - protein, 412 aa, Lactobacillus rhamnosus
  VARIANT (1)...(412): Xaa = Any Amino Acid
MNGGMTLQRVVVTGMGTVNPLGHSVAETVATMDAGKVGIQPITKFDAEKTGITVAGEVKDFKPEERMSKRLSKRMDLFTQYGLYSAIEAYEQSGLTEDAVDSDRVGVIFGSGIGGLTTIQEQVTKMYVKGPDRVSPLFVPEAISNMVAGQFPXYFGTHGPSYVVVTACASATNAIGEAAMRIQTGKADVVITGGAEASVNEIGIAGFAALSALSKNTDPTKASLPFAADRNGFVLGEGGGALILESLEHAQKRGAKILGEVVGYGATSDAYHMTAPDPSGSQAARAMQLAVEEAGIKPSEVGYINAHGTATKANDAMESKAIHDLFGDDVLVSSTKALTGHLLGAAGAIEAIMTLSALQSGRLPMNVVDAAQDEDCPVTLVNRDNRDTSVDYALSNSFGFGGHNAVLAFKRW

We claim:

1. An isolated polynucleotide comprising SEQ ID NO: 31.

2. An isolated polynucleotide comprising a sequence selected from the group consisting of:
   (a) sequences having at least 90% identity to SEQ ID NO: 31;
   (b) sequences having at least 95% identity to SEQ ID NO: 31; and
   (c) sequences having at least a 99% probability of being the same as SEQ ID NO: 31,
wherein the polynucleotide encodes a polypeptide that has peptidase activity.

3. An isolated polynucleotide comprising a sequence that hybridizes to SEQ ID NO: 31 under stringent conditions, wherein the polynucleotide encodes a polypeptide that has peptidase activity.

4. An isolated polynucleotide comprising a sequence selected from the group consisting of:
   (a) complements of SEQ ID NO: 31;
   (b) reverse complements of SEQ ID NO: 31; and
   (c) reverse sequences of SEQ ID NO: 31.

5. An isolated polynucleotide encoding a polypeptide comprising the amino acid sequence of SEQ ID NO: 249.

6. An isolated polynucleotide comprising a sequence selected from the group consisting of:
   (a) nucleotide sequences that are 200-mers of SEQ ID NO: 31;
   (b) nucleotide sequences that are 100-mers of SEQ ID NO: 31;
   (c) nucleotide sequences that are 40-mers of SEQ ID NO: 31; and
   (d) nucleotide sequences that are 20-mers of SEQ ID NO: 31.

7. An oligonucleotide comprising 20 contiguous residues complementary to 20 contiguous residues of SEQ ID NO: 31.

8. A genetic construct comprising a polynucleotide of any one of claims 1–5.

9. A host cell transformed with a genetic construct of claim 8.

* * * * *